United States Patent 12,059,441 (PROBIOTIC BACTERIAL STRAINS THAT PRODUCE SHORT CHAIN FATTY ACIDS AND COMPOSITIONS COMPRISING SAME) - sequence listing, part 13

SEQ ID NO: 29 - DNA, 3656576 bp, Coprococus comes (residues 1-1,828,288 of 3,656,576)
gctgcttgaaagaattgacaggcagaataaagaaaaagcagcaattgaacagatgaggagagaattctctgcaaatgtttcccatgagctgaagactcctctgacctcgatttcgggatatgcagaaattatgatgaacggtcttgtaaaatcggaagatatgcagggattcagtgaacggatctataaagaggcaagcaggatgatcaccctggtcggtgatattatcaagctgtcaaagctggatgagggcagtgtggagcttgaaaaagagaatgtggatctgtatcagatgacaagggagattgtgagccgtctggcacttcaggcagaaaaacgcagaatacaggttgaagtggtaggagaacatgtggaatgttttggaatccgtcagatcctggatgagatgatctacaacatctgtgaaaatgcgatcaaatacaataaagaaaatggaaaagtaaatatctgggttggaaatacactgaatgggaaaaaagtcattgtccaggataccggaatcggaatcccaaaagagcatcaggatcgtatttttgagcgtttttaccgggtggataagagccattccagagagaccggtggaacaggtctgggtctttcaattgtaaagcatggagcacttttgcataacgcagaaatccatgtggaaagtgaagaaggaaaaggtacaaaaatggagcttatttttcattgttaaaaaactgtttacaattgggaaattaaatgtataatgtatagaaaaaagctatgaaatattatagcttttttctattttatatcaaaaacagaatcatgtataataaagagtaatatgactaaaattaaaaaatggttgaattcggtatggaagagtgccggatacaatctgtgtagagattcacatggaaaatgagaggcaactatggaagaacagaagcagagtacgagcagcaattattttaaaggattatccagaagggattatatccagaaagcacatgagatcattcagcaagaagggattcaggcagtatctatccgcaggattgctaaggagatggggtgctcatcagcaagtctgtacaggtactttgataatgtgtctgaacttttatactatgcagaactcagaattttaaccggttacatagacaggctgaatgaggctgagaaatcctggaagaatatgtggcaggtatatgtaggtgtgtgggattgttatgcaacggaggcatttcataatccggaagcatataatctgttattttttgagtataacaatgtaaaactcaaagaagcaatgcgggaatattatgaaatgtttccggaagatattgtaaatgttaaccgctttttctacaatatgcttcagacaccaagctttctggcacgtgattttgagatgtgcaagcggtgtatcaatgttggtggtattacatatgacaatgcagtaaaattaaaccggatggtgtgcatgctctttgaaggctacttcaaagatgtatatgaaaacgggataggggaagagcagattccggaacgtgtaaaactgatggtagatgatgtagatacgatcgttatggctcttgccaacaatctgaaaggctataaaggataccgtaaataaggaaaaaacgccggtttttggttatttttaaatacaatccttgttaaaaatttaattaaattgcaatccccaaaaaacgtggtaaagtatatgtgaaagtatcgaacacacgaaataaggaggcaatttaatggacaatatgaaaggcttcggcatgatgattcaagagctgaagaaaaatccaaaaacgatcgtttttacagaaggaacagatgagagaattcttgaggcagcttcccgtcttttagcaggaagcttccttacaccaattcttgttggaaataaagaagcagtattagaagcagctgaaaagtatggatacaacatccgtggcggagagatcattgatccggatgattatgagagatttgacgagatggtagaactgttctgcgaacttcgtaagagcaaaggtgttacaccggagcaggcagcaaagacacttaagaaaaacaactattttggaaccatgctggttaagatgggagttgcagacgcacttcttggaggagctacttactctacagcagataccgtacgtccggcacttcagctgatcaagaccaaaccgggatcaagctgtgtatcttcctgcttcattttggttcgtccgtcagctacaggtgagaacgaagttcttgctatgggtgactgcgcgattaatctcaaaccatcagaggatcagcttgcagaaatcgcatgggaagttgcagaatgtggtaaacactttggtatcgatccaaaggttgcattcttaagctactctacacttggatctggaaagggtgaagatgtagataagatgcgtaatgcagcagcaaaagcaaaagaactgtatccttcacttccgatcgaaggagagcttcagtttgatgcagctgtatctccgcgtgttgcaagaacaaaatgcccgaacagtgaagtagcaggtcaggcaaatacatttatcttcccggatatcaacgcaggtaacatcggatataagatcgcacagagacttggtaactttgatgcatacggaccgatccttcttggtcttaatgcaccgatcaacgacctgtcccgtggatgcaatgcagaagaagtttattctatggcaatcattacagcagcactcgtagaagactaagagtattgacaaatattcagacgaaaattataatataacaaacaagggcgttttcaaaatggattgagaacgccctttttgtggatgcgatgagccaagtgcagatttgtgcttgcacaacggatctgcatttggcgaatgtacatcacctgatgttggaaaaggtaaaaaatcctcttgcaagcaagcttgcatcggctttctgaccttttgaccctggtatcatcattttatttatgagtagtaaaaacgggaggatttgtatgaatatgaaaaattatacgagagaagatatcctgaatcttgtcgaggaagaagacgtgggatttatcaggctgcagttcaccgatattttcggaacaatgaagaatgtagcgattacagtaagccagcttaagagagcactggataataaatgtatgtttgatggatcttcgatagaaggatttgccagaatcgaagaatcggatatgtatctgcacccggatctgaatacatttgaaatttttccgtggcggccgcagcagggaaaggttgcaagatttatctgcgatatttacagaccggatggaacagcttacgaaagcgatccgagacatgttcttaagaaggtactttccgagacaaaagagatgggatatgactttaacgtaggaccggaatgcgaatttttcctgtttgagacggatgatgcgggaaatccgacgacgatttccaatgaacgtgcaggatattttgatctgggacctttggaccagggagagaatgcaagacgtgatattgttcttacaatggaagatatggggtacggtgtggaggcatctcatcacgagatggcaccggcacagcatgagatcgatctggaatatacagaggcgttggatgcagcagacaatatcatgacatttaagctcgttaccaaaacaatcgcaaaaagacacgggcttcatgctacatttatgccaaagccaaaggatggtatccatggctcaggaatgcatctgaatatgtctctgtcaagagatggaaagaatgtttttgcagatgaaaaagatccgaatggtctgagcaaggaggcttactattttatcggcggacttatgaaacatatcaaagcgatcagctttatcacaaatccgatcgtgaattcctataagagactggttcccggatatgaggcaccggtatatattgcctggtcagcgaataaccggactcctctgatccgtattccacgggtatcaggggaaagcacaagagtcgaactcagaagtccggatggggcagcaaatccatatctggcacttgccgtatgtctggctgccggaatggaaggaattaaaaacaagatcctgccgccggagagtgtagatgaaaatatttacgaaatgacagatgtggtgaaaaatgcacttggaattgaggagcttccggcaagcttaagagaagcaatcacagaattccagaaagatcagtttatgcaggaagtactgggagaagaactgtcacagaagctgatcgagtcaaagcgtgcagaatacagagaataccgcactcaggttacagaatgggaaattaatgagtacttacagaaattctaaagaaactttccaattctaaaggcaggaggctggtattatgagcagtattattgttgtatttccaaaaaaggagattgcaaccaatattcgcaatatactggtacgaaatggatttgacgtgattggtgtgggggtaaccggagcacaggcggttcaattggcagataatctggatgatggaattgtagtttgtggttataaaatgacagatatgttatataatgaattgagagattatctgccgagtacgattgagatgcttttgatcgcatcgccggagaaatgcagtgacaggacgccgggagtgatcagcctgtcgatgccatttaaggtatttgatctgatgaacacgatcgagatgatggcacaatcgattggcaggcggagaaagaaaagaagagcagagcttaagaaccggaatccggagcagcaggcacttgtaaaagaggcaaagagtcttctgatggaacgtaataatatgacggaggaagaagcgcatcgctatctgcagaaatgtagtatggagagcggtgtcaatatggtggagacagctcagatggtacttagtattatggcggaataaaggagattaaagaggcaggatatatgatctttacaaaaatgcatggtcttggaaatgattatgtgtgtataaactgcttcagagaaagggtggaagatccacctggatttgcaagaacactttgtgacaggcattacgggatcggagcggatggtctgattctgatatgtccgtcaaaggtgtctgattttaaaatggagatatacaattcggatggatctgttgccgggatgtgtggcaatggcatccgatgccttggaaaatatgtatatgattacagacttaccggaaaggaaactatcagtatcgagacgaaatccggaattcgtaacatgcaccttcatattcaggatgggaaagcctgcggtgctatggtagatatgggtgttccaagactgaacgcacacagcattccaatcctgagcgaaaaggatctggtgatcaatgatccgattgaggtacaggagaagaactaccgcatgaccgggatttcgatgggaaatccgcatgcggtaatcttttcagaagagataaatgggatttctctggaagagacaggaagggagttagaatttcatccgagatttccggagagggcaaatatcgagttttgtcatgtgactgcgagggaccggatggagattcgtgtgtgggagaggggtgttggtgaaacgcttgcctgcggaaccggagcatgtgcagcagttgtggcttctgtgctgaatgacttgacagatgaggaagtaatcgttaaattattaggtggagagttatctgtcagatgggaccgtaaggtgaatcatgtatttttggagggacctgcggttaaagtatttgatggtgtactataaagatcaaatcacaaaggagacgacatatgtacagtgtaaatgaaaactacttaaagttaccgggaagctatctgttttccaatattgccaaaaaagttgcagcgttctcagcagcgaatccggatgcaccgatcatccgtttgggaatcggtgatgtaacacagccgcttgcacctgcgatcatcgaagcgcttcacagtgcagttgatgagatggcacacgcagagacattccacggatatgcaccggatcttggatatgaatttttaagaagcgcgatcgcaaagaatgatttccaggcaagaggatgtgatattgctgcagatgagatctttatctcagacggagcaaagagtgattctggaaatatccaggagatctttggacctgactgcagaatcgcagtaggagatccggtatatcctgtatatgtggatacaaacgtaatggcaggacgtacaggaacttacgatccaaagacagaaacatggagcaatgtaatctacatgccttgtacagcagaaaatggatttgtaccggaactgccaaaagaagtaccggatatgatctatttatgtttcccgaacaatccgaccggagcggctatcacaaaagatgaactccagaaatgggtagattatgcaaataaaaacggggcagtgatcatttatgatgctgcatatgaagcatatatcacagaggaagatgtaccacacagtatttttgaatgtgaaggagcaagaacctgtgcaatcgaacttagaagtttttctaagaatgccggatttacaggagtacgtcttggcgcaacaatcattccgaaagaccttaagtgtggagatgtgatgcttcattcgctgtgggcaagacgtcacggaacaaaatacaatggagcaccttatattgtacagaaagccggagctgctgtttatacagaggccggaaaagcacagataaaagagcagatcgcatactatcagaagaatgcaagaacgatttatgaaggtctgaagaatgccggatacacagtatccggagcagtgaactcaccatatgtatggttaaagacgccggataacatgacttcatgggaattctttgatttccttcttgaaaaagcaaatgtagttggaactccgggatcaggatttggaccgagcggggaaggatacttccgcctgacagcatttggaagttacgagaatacgttggaagcgatcaagagaattgagaatatttaattgaaaatctggctgcagggacgggcgtcggatcacggtgtagatttgacggtggactctggcgtgaacagcctgtaacatgaaaagaaagagaaaagtgtgataccagactcattcgacggaaaatctgatgattttccatctcaggagtcttcggaatttcgtacttggggtacgaaatccgatcacacttttctctttttttcattaacaggctgtaacacgccgccatataccgccaaatccacaccgtgatccgacgccctgggcgctgcagccaatttaaaatgatacctggctttaagctttattcaaccgttatgtgtgtctataccaaaacaaaatcactcataacatataagtcagaacaaaagtaaatataataagaatggatttcaattctgaacaaacaatccttccatccacagcgaggcgcatctatgatgcgccaatgcggaagctttgaataacgtaagggtgaagtggggacgaggtgacggtttcacgccattcgtaagagccgtgcagtctgttcatttaatcgggacggaaattgtgaccagatttcgtactacaagtacggaatctgaggactgcctgagccggaaaatcatcagattttccagcgaatcagtccggtgtcgcaacttccgtcccgattaaattttacagaatgcaggcgatgaagaccggcgtgaaaccgtcacctcgtccttgcttcgcccgtaaccttattccaaactttctctaaccggtatgagactccgctccaatacccctttcaggtgagcaatagcggttccgtagttcgtgatcggtacgccctgatcttcggcgcatttgaggcgatactgcatttcgcgttcgttcagggtgcagccaccacagtgaataatgagtttataaggtgagagatctaccgggaattcggtcccgcttgtgaattcaaagtgcaggtctttatttccggtatgctggcggatccagcgaggaagcttcactgttccaatgtcatcacattgcctgtggtgggtgcagccttcacagacgaggattttgtcaccatcttccaacttgtccagcatctgtgcgccttcgacctgaagcttcagatttcctttgtatctggaaagcaggatggaaaaagaggtcagtggaatatcttccggtgtatcggcagacactttggcaaatgcctggctgtcggtgatgacaaggcgtggctttttgccaagagacgaaagtgtttccttcaattctgtgtcacgggttacaatagagattgcaccagcctccagtacatcgcggatggtctgctgctgcgggaggatcagacgtccttttggggcggcagagtcgatcgggacgaccagaacgacaaaatcatttggatttaaaagatcgcggacgagatatttatcctgatcttcttccggagcctggcttgcaatcagttcttttaattcatgaacatggtatccggttactgtgctgacttcgatactgttggaagcatctatatgaaaagaagcatccgacatagaatccagattcggacagactgcgccattttcagcagaagagcagaggtcagatttattttttaccacaacgtaagggatcttcttatcctgtattttctttaagatggataaatcttctggtgtcatgccaagagaggcatcgattaccagaacagcgatatctgttttgtttaaaatctggtaggcttttttgacacgcagttcaccgagttctccgatgtcgtcaagccccggggtgtcaatgatcacgacaggtccgaggggaagaagttccattgcctttggaaccggatcggtagttgttccgagaacatcagatacaatggcaagattctgtccggtgatagcgttgatgatgctggattttccggcatttctgcgaccgaagataccgatatgtacacgatctgcagaaggggtgctgttaagactcatagtttttgtaatctccttttttgtattctttttgcgcaggaattcctttgcagtcagtttgaatctggaaatagtgtaacacatatactatagaaaatcaattttgtgaaaatttacttaaaagaaacatataaaactggcaattttggataaaagtttcattgactaaagtgtgaaagtacggtaaaataatcacaagttcataaagaacagaacagacaaggatgtcgcatcagatgcggcatcctttttgtatttcagaaaagaaagtaatcagaagtgcaaagtaatttctcaaacaatcccgggaacgagagagtgtctgcggacggaaagacgctgatcggatatgatgttgatctgttaaatgatctgcaggagcttctgggattcgaaatcgatggtggcctccaggcaatggattattcggcacttactacttcacttgctgaaaataaactggacatcggagcagcagcactttgtgcaacagatgaaagaaaagaagttatggatttcagtgatatctattgtgattccggtcaggtcgttatggtaaataaaaatgacgataaaggaattaagagtgttgatgatctgaaggataaaaaaatagccgttgaaaagggaaccgcatctcatacttatgcaagcaagaaccttacaagtgcaactctcgaagtacatgacacgatcacaactgcatatgaatctttggagcagggaaaagtagatgctgttattcaggatggacctggagcatatttctatattaagacaacatcggacagcaacctggaggtagtcggggatgagtttaatcagggccaggcaccgtattgcgtagcaatttctaaagaatgcaaatattatgatgaaatcaatgcagctgtaaaggtactgattgataatggcacaacagatgaactctatgcgaaatggtgtgaataatcaaagaacagacagcaactaaaaagaagataggatgagatagtatatggatatgacttttttgaatgttttacttccaatgatgtttgagggattaaaacttacgattttaattgctgttgtcggtatcacaattggcttcctgatcggaagcctctgtggatacctgcttcagtcgaaatataaaatagggaaagcaattgcagaagtttacatttggatcattcgtgcgacaccgcttatggtgcaggctttatacggatattttgtaattccgaagcttttgggtgtcgatattggaagcactgcagtgggaattggcgttatcgcactgaattccggtgcatttatttcagaaattgtaaaaggtgcattgatgagcattgatccgggacagaaagaagcaggtgcatcacttggacttacaagtgcacagacgatgatccatctggttatcccaccggcatttaaagcggcacttccggcattatttaaccagtttatcatttctgttaaggataccgcacttttatctgcgattgcggttaatgagatcacgcatcaggcacaggcgtatgcagcgttgagctttaaagcaattcctacatacacagcactggcagcgttttatctggtgatactttcggtactgataattgtccagaaacagatagaaaggaaaatgaggtgattggtatgattaaagtaaatcatttgtcgaagaaatttgggaacctggaggtattaaaggatatcaatcttaatatcaatgaaggtgaagtggtctgtatcatcggaccttccggatcgggaaagagtactttcttaagatgcatcaatcagcttgaaagaccgacaggcggaaccgtacagtatgagggaaagaatcttctcgataagaattgtgacatccgcaaattccgtgaggaagtcggaatggttttccagaaattcaatctgtttccgcttaagaccgttgttcagaatgttatgatggcaccaatccttaccaaacacatgaataaggaagaagcgcatgcaaaagcactggaacttctggataaggtaggattaaaggataaagcggatgtatatccgagtacactttcaggtggacagcagcagagagttgccattgcaagagcactggcaatggaaccgaaagcgctgttgtttgatgagccgacatcggcgctggacccggaactggtaggagatgtacttgatgttatgaaatctcttgcgaaagaaggaatgacgatgatcgttgtaacacatgaaatgggctttgcacgtgatgtggcagatcgggtcatttttatggcagacggatatgttgttgaagaaggcagaccggatgcaatttttacagcaccaagagagagaaggacgcagtcattcttatcccgtgttcttccggcaactgcataaataagacgttttgtaaaaattattgatatactactcataaaggggcaggtgagagcctgccccagtgtaaaaaagatcaagaaaatgagtaaaatacttccattgactttcctatatccgattgttaaaataagaagaaagctaaagaagggaccttcgccatacggcggaggtgtttttggcttatagaaaaatataatttctatattatgatgtaagtgtcaaaagtatcaattgcgtttgtgctcgcacaaataagcaattgatacttattgacactcacatcatattattaaaaagctggagatggtgtgtatggagacaccactgtaaaaggagtgtagaaaagatggaaaagaagaggagtaattttaccggctcgatcggattcgtgctggcggctgcgggaagtgcagtcgggctggggaacatctggagattcccgtatctggcagcaaaaggtggaggcggagtgtttattctgtgctatgtggtactggcacttacctttgggtttacgttgctgacaacagagatcgcgatcggacgtaagacaggacagagtccgcttactgcatatgaacagatgcataaaggatggggaggaatcggtgtgcttgcatgtgcagtaccggttatcattcttccatattattgctcgattggtggatgggtactcaaatatttgtcggcatttctcacaggtcatggggcgcaggcagcagaagacggatattttacaggctatattacacaggtcggacagccgatcatatggatgctgatctatgtgtttattacggcaatggttgtttataaaggagtaaataaaggaattgaaaaatacagtaagattctgatgccgatcctgtttgtactgattgcgggaatttctgtattttcccttaccctgaaacatacaaatgcagatggagtgacaagaaccggtatgcagggactggcgatttacctgatcccgaattttagagggatgacggttaaaagtttcctttcggttgtgatggatgcattgggacagcttttcttctcgatcagcgtggcgatgggaattatggttacttacggatcctatgcgaagaaagagaccaatctgatgaagtcgatcaaccagattgagttttttgatacgcttgtagcgcttctggcaggacttatgatcattccggctgtttatacttttatgggaaccgaaggaatgtctgcaggaccgggactgatgtttgtatctctgccaaaagtatttaaagcaatgggggcagcaggagtgttggtaggaattgtattctttctgatggtatcttttgcagcggttacttcttctgtatctgttatggaggcaattgtatcaagcatgatggataaattccatgtatccagaaaaaaaggaacgatcctgactactttatatggaatgatcgttggtgtgatcgtatgtcttggatacaacaagctttatttcgaactgaaacttccgaacggcacggtagcgcagattctggacgtgatggattatatcagcaataactgtctgatgccgatggtggcactgcttacctgtattctgatcggatgggttgtaaaaccaaaagtgatcatcgatgaagtgacacttggcggatacaggtttggcagagaaaagctttatgttgcaatgatcaaggtaattgcaccgttgatgcttctgattcttttagtgcagtccgtaggattataaaaagaaaatttcagaaaaggcttgacatttagtggaaaataaattattgtaagttacagattttggtgtgtaactgtacggcaggcattaaccatacatagatattattttgatatttgtgtggggttagtgccttttttgcgtcaaaaattcggataaaaggcttccacgaaagaaaataatatcataggcataagccaggtaattaaaatttcttgaggaaaaggagtacatgcaatgaaagacaaaatttttggcgtattgcagcgagtaggaagatccttcatgcttccaatcgcgattcttccggtagcgggtctgctgctgggattcggtagctcgtttaccaatgctaccacaatccagacttatggtctggagaaaattttaggagacggaaccatcctgaattcgttactcattatcatgaacaaagtaggaagtgctgtatttgacaacctgccactgattttcgcggttggagttgcaatcggtatggcaaagaaagaaaaagaagtagcggcactttctgcattgatcgcattctttgttatgaatgttgcaatcaatgcaatgcttgtgatcacaggagagattaccgcagatggaacgatcgcttcgaatgtactggaaggaaccatcacttctgtttgcggaatccagtccttacagatgggtgtgtttggtggtattattgtaggacttggtgttgctgctctgcataaccgttttcacaaaatcgttcttccaaatgcgttatcattcttcggagggtccagatttgttccgatcatttctacactggtgtacatgtttgttgggattggaatgtattttgcctggccggttgtacagaatggaatttatgcacttggcggactggtaaccggaagcggatatctgggaaccctgatttttggtattattaagagagctttgattccgttcggacttcatcacgtattttacatgccattctggcagacagcagtcggtggaacaatggaagttgcgggacagatggtacagggaggacagaacatcttctttgcacagcttgctgattctgcaaatatcgcacatttcagcgcagatgcgaccagatatttctcaggtgaatttatctttatgatcttcggacttccgggagcggcacttgcgatgtaccgctgtgcaaaaccggaaaagaaaaaacaggcaggaggacttctcctttctgcaacacttgcctgcatgatgacgggtattacagagccactggaattctcatttctttttgttgcaccggcactttttgctgtacaggtagtgcttgcaggttctgcttacatgatcgcgcatatcctgaatatagcagtaggacttaccttctctggtggttttctggatctgttccttttcggtatcctgcagggaaatgcaaagacaagctggcttcggatcattccggttggaattatttatttcttcctgtattactttatcttcagtttcctgatcaaaaagtttaacttcaagacaccgggacgtgaagatgatgatacagagacaaaattatatacaaaggcagatgtaaatgccagaaaagaagcaggaaaagaaacagcagggaatacagggaccgcagatccggtaagtgaggcaatcacacagggacttggcggaaagaaaaatatcagtgatgtggattgttgtgcaacaagacttcgtatcacagttcatgacgcagcccgcgtaaatgatgagatcatcaagacaacaggttccagaggaattgtgaaaaagggacagggtgtccagatcatttatggtccacaggtaactgtgattaagtctaaactggaagattatctggaaacagctccggatgaatattatgagagcgctgctgtgtcagaagagaattcagctgaagaaaatacagatactgtaaatgaaaataatgaaacccaggaaaaagtggtaaatacaattgttgtatccagtccgatcaccggtatggcaggcgatattacaacctgtccggatgaaggatttgcaggaaaaatgatgggtgacggagctgttgttacaccggaagatgctgtgatctgcgcaccggaagatggagaagtgcttttcgtatttgaaacaaagcatgcacttgggttccagacagaaagcggacttggcatgctgcttcacatcggtattgataccgtatctctgaacggtgaaggatttgaagtatttgtagaaaatggtcagaaagtgaagaagggggatccgcttatgaagatcgatattccattcctgacttcgcatgcaccgtctctttgttcaccggtactttgtacagaactggaagagaatcagagagtacgtctccttgcgacgggagaagttaaagccggcgatccactatttgccgtagatacagtagaatagaacagcgaaagctgttttaataatggcggcgctttggcaagcaaaacgctgtcaaaaaagtaaactaaaaatgaaagaaaaagacgaggagaatttatcatgaaagaatttaagtatgtagtaacagatgcacagggaatccacgcaagaccggcaggaattctggtaaaagcaattgcgaaaaaaacttcagatattaagatcaaaaaagcaggagatacacgtgaagtcaatgcaaagagcattatggcagttatgagtcttggcgtaaaaaaaggaaatgaggttatcatcacagctgaaggcgaagacgaagaagacgcaatcgccgaaatccagaaagtattagaggagaatctgtaggattatgattacactaagtggtaaaagtgtttttggtggcgtagccatcgggaagattgctttctataaaagacaggaaaagcaggtaagacggtatcatgtagaggataccgaagcagaggcggcacgttttgaggatgcccaggagactgcgatcgcacagctcggtgagttgtatgacaaggcaatggaagatgtaggagaagccaatgcggcaatttttgaagtacatcagatgatgctgatggatctggattatgtggattcgattaagaatattattaccacccaggaagtcaacgcagagtatgctgttgcgacgacaggagataacttctcccagatgtttgcctctatggatgatgcttacatgcagggacgtgcggccgatgtaaaagatgtatcggaccgacttctcggtatcctttcggatgccggggaaagcggtgttgtggcagatgaaccggtgatcgtggcagcagatgatttggtaccgagtgagactgttcagctcgacaagtccaaagtgcttgcatttgcaaccatgtacggatcagcaaattcccatacggcaatccttgcaaggaccatgaacatcccggccgttattggtttgggagaagggcttgcaaaagaatatgacggacatatggcagccatcgacggctttaccgggaccgtctacattgatccggatgaagagaccatgaaggctatgaccgaaaagcgcgaagaagaccgcagacagaaaacacttctggaagaactgaagggcaaagagaatgtcaccctttccggacagaaaatcaatgtctatgcgaatatcggtaatctttccgatgtgggcgccgtacttaaaaatgatgcaggagggatcggacttttccgaagcgagttcctgtatctggaaagcgaagatttcccgaccgaagaacagcagttccaggtatacaaacaggttgcagaaaatatggcaggcaaaaaggtcattatccgtaccctggatatcggagcagacaagcaggtggattactttggacttgacaaagaagagaacccggcactgggataccgggcaatccgtatctgcctgacaagaccggagatcttcaagacccagcttcgtgccctgtaccgggcatctgcttacggacagatcgccattatgttcccgatgatcatttcggtaaaagaagtgaagcagatcaaggtgatcatcgaggaggtcaaagaagagcttcgtgaggcacagatcccgttccgtgaggatgtggaactgggaatcatgattgagacaccggctgccgttatgatgagccgtgagcttgcaaaagaagtggatttcttcagcgtagggaccaatgatctgacccagtacacgctggcaatcgaccgtcagaaccagaagctggatgccttctacgatccgcaccacccggcagtccttgcaatgatccgcatggcagccgaaaatgcccacgcagaaggcaaatggatcggaatctgcggcgaactcggagctgacctcgaactgaccgaagaattcttaagcatgggattagacgaattatccgtatcccctgcaatggtacttccgctcagaaagaagatccgggaaaccaaataaaatctattcacagattttgtgataatcacatcgaaaacatcaaacaaacttacggggctaagcacgattcatcgtgcaacagccccgttctgcttttatttgttttttgcggaagctatttcacacccgtcagaaaacagccaaatttgcgttccctttttctcaacctttttttgactttcccctcattctctgctaggataaaatcagaacttaaaactcgtcttcgggggaatcagatatgtacagagtaagcaaaattttgaataataatggcgtgatcgcaatcaatacagaggataaccaggaatacgttcttctcggtaaaggaattggctttggaaagaaggtcagtcagcgttttgaagtgacagaagatacagcaacttaccgcctgaccgaacagacagacagaggatctgccaaatctctggtgcaggagatggatccggaatttctggaaatcgcagatgaggtgattcgggaagcagaaaaagtttttgggaaagtagaccgccggatcatgatcccgctggcagatcatatctcctttgctgtttcgcgaatccggaatcaggagcagatcagcaatccactgacagatgatatcagagtactttttcataatgaatttcaagcagcatccgtgctcagagatattttgcagaagagaatgcagatcacgatcgatgagcatgaaatcggatacgtggcacttcacattcattcagcaatcgaggatgaaaaagtgtctgtggcaatgcagacggcccgtgcagtgagagaatgtattgagatgatcgaaaaagaaacaggaaaaaagatcgatgtgatctcgctttcctataatcgtctgatgaaccatatcaaatatatggtagcacgtgctatgacgggggaggatcttcgtatcaatatgaatgaatatatagaatccaaatttccggaagcgtatatgactgcaaaaaaagtctgcgatatgctcggaaagagtattggaaaagaacttgatgagatggaaatcgggtatctggcaatgcatatcgaacgaatctacagtgaagaaataaaggcataacagaggaaccggcttttgccaaaagattgacactacggagaaacaaatggtataatcggaccaaagtttgaacattagtctaaggagaaaggttggtacggtaatggctacaaaagaacagatggaaaaggtgaaggatattgttgtgaaactccgttatctggagtgtatggataatattatttactatgacagatggaataactgcccgaaggacggatttgattatgaagggaaagtcggagcatatctgacagagctttctaatgagaaactgacgagcaaagagacaaaagaactggtagagtcactggaaggagagacagcttttgattcagatacagacaaaggtatggtacgttatctgatcggaaagtataaagaagcagtacagattccggcaagcctgcagggagaattgaatcaggcaaatgcagatggacagctggcatggggaaaatgctatgaagcagatgattttgaaagctttaagccggtactgaaaaaacagtttgatttacaggagaagatagcaacagcgatcaatccggatgaaaaaccatatcaggttctggtgaaccggtttgataaggattatcgtctggaagagattgatgcaattttggcaaaaatcaaagatgctgtctgcgaaattttaaatgcggtaagagaagaacagagtaagattgatgattccattctggaatgtgaagcagatcatgatacagtacttcgtattgtgaagaaagcgcaggagatcctgggacttgataaagataagagtactttatttgagatccatcatccggtatgtgtctgcaccggacctcgtgattccagaccatccacaaactgtgatgagctgatccatgcgattctggcagtggttcatgagaccggacacggactctataattataatgcgaacgatgaggttgcagaaagcggactctggggcggaattgaaggtgcaatgcatgaatcccagtccagattctacgagaatcatgtaggaagaaccagagaattctgggagaacctgtacccatatctgcagaaggaagtgccaaaatacaaagagatttctctggatacattccttgcggcactcaataaagtaaaaccgggactgatccgtctgaaagcggatgagcttaccaataccctgcatatcatcatccgttacgaaattgaaaaagaatatttcgatggaaaactgacagtggatacaattgaagaagcatggaacagaaaatatcaggaatatctgggatttactccaaagaatcatcaggaaggaatcctgcaggatgtgcactgggcttcaggatgtgtaggatattttcagggatatgcacttggagatgcttacgcagcacagtttgctcataagcttcttgctgattgcccggatgcatttgaaaagctgggaaaaggagattcatctgtaattggaaactggttaaaagaacatattcaccagtacggacagacctattctgcgcgcgagatgctcaaaaaagcaacaggagaagagctgaataccggttattatattgaatatctgaaagaaaaatatttacactaagcgcagagggcaggaggattgaccaatgaataaagaattttacgcaggaaatcgtaagagcctgtatcagaaacttgaagcgggatctttggtggttgtattcagcggacatgcaccgatcaagaccaatgatgagaattatccgttttttacaaatcgtaactttttgtatctgacaggaattgagcaggaaaatattgtactgatgacttatgtcggagagggaacaattgaagaaactctgtatcttcttccaccggatgcatttgcagaacgctggaccggaagacgtataaaagaagaggaagcagaagaactttccggaattacgaattacaaatatgtggcagcattccggaatgatctttccagacaattattttctggcaatgttaagaaagtttatcttgattttgacaaggtttatgaaaatacgccggcagtagaagcataccgccttggcaagtatctgaaagaacatgctccgtttgttggacttggcaaccttcatccgatcatgaaacagcttcgcctgatcaagaaaccatgtgagattgaggcaatgaagaaagcggaaacgatcacaaaggccggaatcgaagcaatgatgaaaacatctaaaccgggaatgtacgaataccagtataaagcagaatttgattatgcactggctcagaggggagtgctttcaccaggatttccgtctatcatttcatcaggaaagaacaactttaaaattcattactatgattatcgcggacaggcacaggatggagatatgatcctgaatgacgttggtgctgtatgggattatgagatcaacgatgtatccagggcatttccgtgcaatggaagatttaatgaccgtcagaaattgctttatgagtgcatttacaatacttcagaatatatgttcagtacactgaaaccgggtgtaccgcttctggatgtggataagatcatccgtaaatatacatttgaacagttaaaagaagcaggagtatgcaaaaattttgaagatattgggacttacatgtggcacggtggagcacatcatgttggatttgatgtacatgacgtggtagaaggaagcggacttgctgtaccgggtgttgtattctgtgtagatatcggtgtttaccatgaagaatggggcattggattccgtctggaagataattgcctgatcacagaagacggatgtgaaaatctgtcaagagcaattccgagacagatcgatgagattgaagcatttatgggacgcagataaatagaaaacagggaaagagggagctgtatagaaaattacggttcccttttcctgaaatatggagagctaggatatggaaaatagaaaatcacggaaaagtacatttctttatgtaatactattaactttatgtgtaccacttgcatatgtctatcttattcttgttacgggactgctggataaaatccaggaggggcatatcggattaacgttgatgattgtgtttcttccactgtttttttattggggacttgtggcagttgtgggaatcataaatattggacagtcatttaagatatacaaaacgggaaatccgattgaatgcgtgaatcgcatgctgatccataaatatgggctggttgtttttttctgtgtgaattttctggttctgttcatttattattttttcataagtatggcagtgctggtaggaagccggggagccgcgataatctttgctccggtattgctgccatggctgattgtagcagtcgttttttcggttggtgcaacatggcttgctattttaccgggaagcttttatgggatccaggtgatccgtatgacctataaaagtgggaaaatagggtttgccgaagcagttgtacatacggtattccagtttttctttctgtttgatgtgttggatgcaatgtatcttgcaacggaaaaatggggaagagggaaaaagagttctgtaattattgggtgtgtgtatctgtttgcagtttttgcaaccatatatctgataattaaaatgaaatcaatgttttaaaatacaagcagttgtatcagagtgttggtacggctgctttttgtaaatgtgaaatgaaaaaggaaatggaaaggcaaatggaaggggatgttcagccgcgccattcgcaaaagcatgttaaaatgatgccagaatattctgaattgcacaaaatataaaaacaacattgacaattcaggaaaggcgtggtaagataccatatgttcgctggtcgagacagagactaaggagtggcatgcagaggcagagcggatgaaaaataaaaaagctgttgacaagccttggtgaatatgctattctaaataagctgtcgcgtgaggaactgcttcacaacagcaaaaaagaaataaaaaagttgttgacaaacatgaaacactttgatataatataaaagctgtcgcatgaaacggcaacaacaaaaagaacattgataactgaacaatagacaacaaatcctgaaaattcttacaagagattttttaagaacggacatcgaaagatgtcgaaccagaacagtaaacaggaacagaattgccaagcgattctgacccggatacaaacatttttaacgagagtttgatcctggctcaggatgaacgctggcggcgtgcttaacacatgcaagtcgaacgaagcactttaacctgattcttcggatgaaggtttttgtgactgagtggcggacgggtgagtaacgcgtgggtaacctgcctcatacagggggataacagttagaaatgactgctaataccgcataagaccacagagccgcatggctcggtgggaaaaactccggtggtatgagatggacccgcgtctgattaggtagttggtggggtaacggcctaccaagccaacgatcagtagccgacctgagagggtgaccggccacattgggactgggacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggctgtgtaagtctgaagtgaaagcccggggctcaaccccgggactgctttggaaactatgcagctagagtgtcggagaggtaagtggaattcccagtgtagcggtgaaatgcgtagatattgggaggaacaccagtggcgaaggcggcttactggacgatgactgacgttgaggctcgaaagcgtggggagcaaacaggattagataccctggtagtccacgccgtaaacgatgactactaggtgtcggggagcaaagctcttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccggtgaccggcatgtaatgatgccttttcttcggaacaccggtgacaggtggtgcatggttgtcgtcagctcgtgtcgtgagatgttgggttaagtcccgcaacgagcgcaacccttatcttcagtagccagcaattcggatgggcactctggagagactgccagggataacctggaggaaggtggggatgacgtcaaatcatcatgccccttatgagcagggctacacacgtgctacaatggcgtaaacaaagggaagcgagcctgcgagggtaagcaaatctcaaaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctcctttctaaggaagctggataaaagtaggacgcgaaagtggctgaatcaatccaactaaaacggaagaagaagtaaggaagaatgttgtctattgcttagttatcaatgagtgagtgcacagactggatgacagaggtgcgatggaagcttgcttccgtgagcgcatatggcagacgggatgtatatgaaggattgaacgtagcccgaaatgaagcaaagcggaattgagggtgaagagagagactgcactcacggagtataactcaatgcttctggtggcgatgcggtcaggggacacacccgttcccatcccgaacacgatggttaagacctgatcggccgatggtactgcactggagacggtgtgggagagcaggtggccgccagattataaaaagtttaatatgaaaaaagaaatgaattgatctttaccagtgatcagagattaaaaaggattttggtttctgatgactgataaacatcagtcagacatgtacattgaaaactgcatacaaaaataaatcaattctcaaatagagaaagacatccgaggtgatcatcaccgcaaggtaatgattaacttacatcttcgagaaaacgaagtaaaaaaacgacctgaaataccaacgcatgcaacgctatgcatgtgtacctgatctcattcccgtgagagaaggaagttggttatgctagaaagagcgcagggtggatgccttggcactaagagccgatgaaagacgtgataagctgcgaaaagcttcggggaggagcaaatatccaatgatccggagatatctgaatggggaaacccggctggacagactccagtcatccatacgccaatccataacgtatggaagggaacccggtgaactgaaacatctaagtagccggaggaagagaaaacaacaagtgattctgtgagtagcggcgagcgaaaacggaagagcccaaaccggaatgcgtgcattccggggttcggaccgcgtaattgatctgacaagtttagcagaatggttttgggaaagccagccagagagggtgaaagccccgtaagcgaaagacgagtcagcaaggcgggatccagagtaccacgagacacgagaaaccttgtgggaatgagcggggaccaccccgtaaggctaaatactccttagtgaccgatagcgcatagtactgtgaaggaaaggtgaaaaggaccccgggaggggagtgaaagagaacctgaaaccctgtgtttacaagctgtggaacatctatatatgatgaaccgcgtactttttgtagaacggtccggcgagttacgccatctggcgaggttaagttcttaaggaatggagccgaagtgaaaacaagtcttaacagggcgttaagtcagatggagtagacccgaaaccgggtgatctatccatgtccaggatgaagttgccgtaaaaggcaatggaggtccgaacccacatccgttgaaaagggtggggatgaggtgtggataggggagaaattccaatcgaacccggagatagctggttctcctcgaaatagctttagggctagcctcatgagagtcttttggaggtagagcactgaattcccgcgggggcgtcaaagcttaccaaaggatatcaaactccgaatgccagtaagatgattcatgggagtcagactgcacgagataagttgggcagtcaaaagggaaagagcccagacctgcagctaaggtcccaaaatgtgtgttaagtggaaaaggatgtgggatttcaaagacaaccaggatgttggcttagaagcagccatacattaaaagagtgcgtaatagctcactggtcgagaggtcctgcgccgaaaatgtccggggctgaaacacactaccgaagctcaggaattaacgtagttaattggtagaggagcattcttaaagggaagaagcagtaccggaaggagctgtggacttttaagaagagagaatgccggaatgagtagcgagaggaaggtgagaatccttccggccgaatacccaaggtttccagagtaaagctgatctgctctgggtaagtcggggcctaaggtgaggtcgaaagacgtagccgatggacaacaggttgaaattcctgtactgcagtataacagaactgtggggacgcagagggagagcactagcgggaatggaatcccgcggcaagcgaggtaggagtcgcgctggcaaatccgcgtgacaatccgaagacgtgatgcataccgaactgaagtagggaaatgtgtgagccagctgccaagaaaagccgctattgtttgtactgtacccgtaccgtaaaccgacacaggtaggtgaggagagaatcctaaggccgacgggagaagcattgttaaggaactcggcaaaatgactccgtaacttcgggagaaggagtgccagtgagagctggccgcagagaattggcccaagcaactgtttagcaaaaacacaggtctatgcaaaaccgtaaggtgaagtatatgggctgacgcctgcccggtgctggaaggttaaggggagaggttagcgcaagcgaagctttgaacttaagccccagtaaacggcggccgtaactataacggtcctaaggtagcgaaattccttgtcgggtaagttccgacccgcacgaaaggcgtaatgatttgggcactgtctcaacaatgcacccggtgaaattgaaataccagtgaagatgctggttacctgcgccaggacggaaagaccccatggagctttactccagcttgatactgggattcgatattgtatgtacaggataggtgggaggcgaagaagcattgacgccagttgatgcggagccgctgttgggataccacccttgcagtattggatttctaaccagcagccgtgatccggctgggggacaatgtcaggtggggagtttgactggggcggtcgcctccgaaagggtatcggaggcgctcaaaggttccctcagaatggttggaaaccattcgaagagtgcaaaggcagaagggagcttgactgcgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgaagtaggtcccaagggttgggctgttcgcccattaaagcggtacgcgagctgggttcagaacgtcgtgagacagttcggtccctatccggcgtgggcgtaggatatttgagaggagctggccttagtacgagaggaccgggctggactgaccgctggtgtatctgttgttccgccaggagcatggcagagtagccaagtcaggaagggataaacgctgaaggcatctaagcgtgaagccctcctcaagatgagatatcccaacgcaagttgtaagaccccttgaagacgacaaggtagatagggcagaggtggaagtgcagtaatgcatggagctgactgttactaatcggtcgagggcataaccaagaaggtaggacagggtaaggaagaatggatggagtaaagatttaaatttgtatgtggttttgaaggtacatgtaaaaagtaagggagctgtagaccgtaagggtttgcagtttttttattgctcagaggtgatcagcctggaaaaaaatgcagaagagtcattcatgctgtttaataaagatgcagactaccagctgcatcttccacaatttgtacatggtatgcagttcttttttttaataacaggataccacggctttacctgcagattcggtaagttattgagctctaaaatgatagaatgataatgatcagaaagagtaatccggtctgaatcatgctgttcgatagtcagtgggtagatggttttttgatcaggagacatacaattttgatgtaaaagaggggtatagacatctgtaccaatttggataaattgatcgatggtgatgattttgtaatcatcagaagagaacgaaatgattgcaggagacacagccaaagtgtcttccgcaggaattttataagagtcagtagtaaattctccaattggagtttctagtttcatcatgtgttagcacttcctttaatatcttataaatgaaaattactcgtttttcagttcttctttcatggcgctgtcttttccctgcataaaatggtcttttttcaggattgcaaaagcccgctcataatcatttttacgcatatatttaaccatttttttcaaattctcattcgttggaacgatccgcatgccgtttttcagcgaatacatacccactcttaccagctctgataaattggattcatagaatttggtgatccggtcattattgaaaatgctgacaatttccagatgcatctgcgtatcagcaagctcccacttgtaaacatcggaagcaaccgcacacatatgtaccactttttcttcaattcgataggaatattcttccgcttttccaccttcaaagatcagtttaaatgcactaccctctaagagttcgcggagctgataaagttcattgatatctttatcggtgatttcttttacagtcatggatttataataatcggtaacgatcagaccttcagactgcagcattttgagtgcagtgcgtaccggattacggctcataccgagctcttctgtcagaagtgcttcggtaagaggcattcctggtggataagtcagattcataatgttatttttgataatttcataagcctgatcggcaagtgatttctttttttcagccatgtgaaatccccctctgtctggtgaatatattaagtataacacattaaaacggggtttgtaaaaaataaaattaggtatatgtatagttgcgtttaatataagagtacagactgatgattgtatacaatggtgcatgtattttcgacgaaaaacggcactttctattgtgaaaatgttgactttaaacagagaaagtgatacattgaatgcagaaagaaatttgtatacaaattaaatgattgtatacaaattaaaaacgaaaatatataaggttttaagttcatcaggaggagaaagactatgaaattaggatttatcggaacaggtaatatggcaggagcaattatgggaggcgttattaaaagtaatgtattcaaaccggaagaaatcatcggagcagatctttttgcaccaggtcgcgaaaaagtaaaagaactttatggaatcaatgttactgatagcaataaagaagtaattgaaaagtcagaagttgttattttttctgtaaaaccacagttttatgcagatgtcattcaggaagtaaaagatctggtaagaccggaacagcttattatcacgatcgcaccaggaaagacacttgcatggcttgccgaacagtttggaaaagatgttaagattgttcgtacaatgccgaacactccggctatggttggagaaggtatgacagctgccacaccgaatgaacatgtaacaaaagaagaacttgattatgcatgcaagattctttctgcatttggtaaagtagaagttgtggcagagcatatgatggatgcagttgttgcagtaagcggaagttcaccggcatatgtatttatgtttatcgaagcaatggcagatgctgctgttgcagagggaatgccgagagcacaggcatacaaatttgcagcacaggcagttcttggaagtgcgaagatggttcttgaaacaggaaagcatccgggagaactcaaagacatggtatgctcaccggcaggaacaacgattgaagccgtaggtgtattggaagaacacggattcagaagtgcggtcattgatgcaatgaaggcatgtgttgatgttgcaaaaggaatgtagatacgatatacttgtttacggggaaaaacatgtccacgtaaacctgagaaggaccggggcgtatgacgcagccggtctttttttatctattaagaaaggtctttcctgataataaaaaacgctccgcgtggaacatgataccataggaggtagatagatggcagcaaaacagaatgtaaagcggcggattgtagatgccgcatgggaattgttctatgaaaaaggatatgatgatacaacagtagatgatatcattcgtctttctgagacatcaaaaggatcgttctattattatttcagcagcaaagattctctgcttgatacattgtcaactattctggatgagaattatgcaaagcttgaagatgaactggatccggaaatgaacagttttgataaactgatgtatctcaattaccggtcgcattcatttatggagcaaaagattgatgtagcattgttatcatccttatattcaacacaattgattgccaagggagacaggaatcttctggatcagaaccgtacttattacaagctgatcagcaggatcatagaagaggggcatgtgcgaaatcagatcagcagagagaagagtatccaggagattaccaagtattattcactctgtgagcgggcactggtatcagactggtgtctgaacagggggaattattcgcttggagaatacagtaaggaatatatgccgattttaatggaacatttccgggtagatcagcccgaatagagaaaggttttcatatgaaagagagtcagagaaaaggtttaatttcagtacatgttgctgtggcattgtttggttttgtcggactgtttgccaagctggtagatctgcctgcagtgatcatcgtgcttggaagggtatttttttcatctattttcctctggatttttctgcgttttaaaaagcagaaaattcgcctggaggagaaaagtgattatttgtggatggtcggagcaggtgcagttttagcaatacactggagtagttatatgcagtcgatccagagttcgacggttgcagttggtacgcttacggtatcaacttttccggtatttgttatttttctggagccatacctgttccatgaaaaactgaagaaatcggatgtgttttgtacactgatgatgctggtcggagtattctttatcgtacccgcatttcagatggataatcagattacacagggagttctgtggggacttctgagtgcatttacctatgcaatattgtcactgatgaatcgccgtttttccagcagatatccggcaacactggtgtcgctttatgaacagggaactgcaacgatcgtgttgatcccgatgatgtttgtgttgaagccggtgattacacttgcagatgcaggcgtattgatgatgcttggaattatttttacagcagttgcacattctttatttatcagtggacttcggactgtgaaggtaaggattgccggaattttatccggactggaaccggtgtatgggactttaagcgcatttctgtttctgaaagaagttccaagtttcagagagtgccttggtggtgttatcattctggctgctgtgtttttatcgacactgaaaccggaggagaaagcatctgatgctccggcataagaataaagagaagtttgaggattttatctggcactggtttctggtgatcggatattgtctggaaaatgtataaagactttctaaaaactatttacggacgggaaaagttccgttacaataggtagagaaatcaatgaaaaggagattgtataaaatgacaaatccagtagtaacatttgaaatggcaaatggcgatgtgatcaaagcggaattatatccggaaatcgcaccgaatacagtaaataactttgtatctcttgtaaataagggattttatgatggactgatcttccaccgtgtcatcagtggattcatgatccagggtggatgcccggatggaaccggaatgggtggccctggatacagtatcaaaggagaatttaagcagaacggttttgcaaatgatctgaagcatgaaccgggcgttctttctatggcgcgtgcaatgcatccggattcggcaggatcacagtttttcatcatgcataagacttcaccacatcttgacggcgcatatgcagcttttggtaaagttacagaaggtatggatgttgtaaataaaattgctgagacggcaacagactacagtgacagaccgctggaagaacagaaaatgaaaaaagtgactgttgaaacttttggagaggcttatccagaaccagagagagtttaacaggagttacaaagcagacaacacttggagagacagaataataaagacggagggagccggtgaaagacagactgagaggaagcaaaagagcatcgccccttttttacctgatacggatcatgccgtcgcaggaagtcatattgattttttcagagacacttgtgcatggcaggtgtttcttttatttcataggaaattccgaaggaacttcctatgaaataaaaggcactgcgtgccggagatgcacacttgcacgaagatgaagaatgtcgcaagcgaccgtgctcggcgcgagaatgtgccaaggcacattctttttatacaaaatatttaggacaattatggaaaaagagaggaagagagtcaaatgagaacagcacttacaattgcaggaagcgattcaagcggaggagcaggtatccaggcagatatcaaaacaatgatcagtaacggagtctatgctatgagcgcaattacggctcttactgcacagaatacaaccggagttaccggaattatggaggtaacgccggaattcctaggagaacagctggataatattttcacggatatttacccggatgcagtgaagattggaatggtatcttcaagtggtctgatcacaaagatcgcagacaaattaaaagaatatgatgcgaaaaatattgtagttgatccggttatggtagcaacaagtggagcaagactgatcagcgaggaagcgattgatgcgctgaagagctgcctgcttccgatggcaaccgttctgactccgaatatcccggaagcagaagtgcttgcaggtatgaaaatccagtcgcaggcggatatgataagagcagcagaagagatcggcaccaaatatcactgtgcagttctttgtaagggcgggcatcaactgaacgatgccaatgatctgctgtggagagatggtggatataagtggttctacggagagcggatcgacaatccgaacacgcacggaacaggatgtactttatccagtgcgatcgcatcaaatcttgcaaaagaatatgatttggatgagtcagtagaacgtgcgaagaaatatatatccggagcacttgcagcaatgctggatcttggcaaaggcagtggtccgatgaatcacggatttgcaattaaaaatgaatatacagaaagcaaagtggaggaatagaagtatgaatgaaaagagaacctctatctttgaaaatggactgatctggtttggggcaggcgtgtcccttgcagagatcctgaccggtacttactttgcgccgcttggattcggaaaaggagttctggcgattattattggtcatatcataggatgcatgatgcttttccttgccggagtaattggtggaaaaaccagacgaagtgcaatggaaacagtaaaaatgagttttggcgagaagggaggaatcttcttctccttcctgaatgtgttgcagctggttggctggacagcgattatgatttatgatggggcacttgcagcaaatggtgttcttcataccggcagatgggtatggtgtctggtgatcggtgcactgatcatcttatggattgtgatcggaatcacaaatcttggcaagatcaatacggttgcaatggctgctttatttatcctgacactggtactcagcagagtgatctttggtgacggatcggtagcaggcgcaggcggagatgccatgacgtttggtgcagcagtagagctttctgttgccatgccactttcctggttgccactgatcagtgactatacaagagaagcaaaagaaccggtaaaagcaaccgcagtcagcaccgttgtttatggagttgtcagttgttggatgtacgtgatcggtatgaacgctgcaatttacacaggagagtctgatattgcaagtatcatggtaaaagctggacttggaatagcaggacttctgatcattgtattttctaccgttacgacaaccttcctggatgcttactcagcaggaatttcgtcagagtcagtattttcaaaaatcaatgggaaatatgcagcaattgttgtaactgtgatcggaatgatcggagcaatcatttatccgatggacaacattaccgatttcctgtacctgatcggttctgtattcgcgccgatgatcgcaatccagattgcggatttcttcattctgaagagaaaggacagcctggaagtatctctggatgttatgaatggtgtaatctgggtgatcggttttatactttaccgtattctgatgaatgtggatattccgcttggaaatacactcccggatatggtcattaccatcgtgatctgtattcttgcaagaaaatgtataaagacagaaaaatagctttgaaagaaaatggaaatgccgtgttgacatttccattttcttttgacagaacatgtagcgatttacagaagagaggcggaaaaatgaatgctgacgcctggaaacgtggtaaaagtttataagaaagaagttttggataatttagttagcggatggaataaagtgggatttttatcctacaaaatatatatggaaaaagagttgggtaaaatgaaaaaagagcttacgacatatgatcgggggaaatgtcgtaaactctttttccaataatttcattaaaggagaaatgaaaataaaaagtatcaaaatactgaaaacgtcttattttgttcggttaagtgttatccttaacttgtttttataatagcatttgcagggagttttgtatattcgcaaaaaaaactaaaagaactgcaaagttaaaataaaattgtgcaaaataacgaagtgcaaaacaagattgacaaaagaatgtaaaaaaaggaaattttaacggtaaaaatatataatgtctaataattaacaagaagttacagaaagttacaaggaaaactgtaatttttgaaagtatattccggaagcagggtgggaaaaacagaggaggatactgttggtgaatgccggaaagattcagataatggaaaaagagcttgcgacatatgatcgggggaaatgtcgtaagctctttttctgtaatttcattaaaggagaaatgaaaataaaaagtatcaaaatactgaaaacgtcttatttggtttcgttaagtgctatccttaacttgatattataataccatgtgtatgctcttctgtaaattcgcagaaaagacaaatgttacaaaaatgatactgtaaaattgtgcaatatagccaaaaacggtgcaaaaaatggaaaatgtgaaagttttataatcttacgacttcatatttgatttgcttttccaatatgttaaaattaaaaaaagcagaaaattttacagataaggggaaagatgatgaaagaatttgttgaaatgcgggatgttcgtaagatttaccgtatgggtgaagttgagattgccgcagcagatggaattgattttcagataaaaaaaggtgaatttgcagttgtggtaggcccaagtggtgcgggaaaaacgacagtgcttaacattctggggggaatggatacggcaacaagtggagaggtctggatcgatggaaagaatattgtaaagtattcgccgaggcagcttacttcctatagaagggatgatattggatttgtattccagttttacaacttgattccgaacctgacggcgcttgaaaatgtagagttggcactgcagatctgtaaggatccgctggatgcggagatggttcttagggaagtgggactggcagaccgtatgaagaattttccggcacagctttccggtggggagcagcagagggtatcgattgcacgtgcactggcaaagaacccgaagcttcttttgtgtgatgagccgacaggggcgttggattacaataccggtaaggcaatattaaagcttttacaggatatgtgtcgtgaacgagggatgacagtgatcctgatcacacacaactcagcgatcacgccgatggcagatcgtgtaattaagatgaagaatggaaaagtcggaagcatgaagctgaatgaaagaccggttccggtagagacgattgaatggtaggtggacgtaaagaccgatgaagaaaaatgttttacgcaaagattttataatagaaataaaaaagacgatgggacggtttgtatcaatcttttttatcgtagcattgggtgtcgcattttattcgggaatccgtgcatcagagccaagtatgcggatcactgcagatcagtatttcgatgattcagagctgatggatctgaaggtaatgggaaccatgggacttaccaaagcggatatcaaagcaattggaaaggtatcaggaattgaagctgtagaaggcggatacaccaaagacgtgctttgcccggttggagacaatgaaaaggttgtccatatgctgagtatgcagaagaattttaatcaggtttcggttgtggaaggcaggctgccggaaaaagccggagaatgtctggtggatgaagattttctgagctatacagacctgaaggttggcgacacggtaactttccattccggcgatggagaggcgttgacggattcactggttacagatacatataagattgtcgggatcgggaacagtccgctgtatatttcatttggaagaggaagcagtacgatcggaaccggagagatcagtggatttgttgtagtggataaagcttcttttgacatggatgtttatacggaagcttatgtgaaggtgagcggtgcagaagagaaaacggcatttactgatgaatacaataatctgtcggatgcagcaaaggaagccgtgagtgcaatcgaagaagaacgctgtgcagttcgcaaacaggaaatcgtagatgaggcaaatgaaaagcttgctgattcagagaagacagtgaatgaaaaatcgcaggaactggaggatgcgaaaaaagagctggagagtgggaaaagcaaggcagccgaagaactggaaaaagcaaagcagcagcttacggatggagaagcggagcttgcgtctgcaaagcagcagatcgcagacggcgagacacagcttgccgatgcaaaagcgcagctgaatgataagcaggcacagcttgattcggtggaggcacagtatgaatccggaaaagcacagttggatcagaaagaacaggagcttgcagatgcggaacaggtttatctgagtaattactcgaaatatatgccgatcattacggcggggaaggaacagattccagcaggaaagtcacagatcgcggatgagaagaaacggttggacgagggacttgcaccgcttaatcggctgaaagacgaactggctgggattgaagatgaaatcagtcagtgtgattcggagattgcggaattgcagaagcagataaatgatggagattcattatatcaggaatacacaaagatctcagagcctgatagaacgccagagcagcgagtatatctggaaagctggagtggagtccgaaagggactggaagcaaagcttgctggtatacaggagcagaaagcaccacttgaaggtaaaaagaaggacttgctagtgcagatgaaccaggcaggttttgccacagaagcagacctggaggcacagatcactgacctgactgagcaaaaagcagatttggatgcaaaagagacggcacttcttcagcaggagcagacacttgccgcacaggaagaagagctgttaagtgcaggcagacagattacagacggcaagagtcagatcgcagcagccagatcccagcttgacagcacaaaatcgcagattacggacggaaaagcacagatcctgtctgcatgggcacttctgaatgaaaaagaggacactttaaatgcgagtaaagcacaacttgcatccggtgaacaggagcttgcggatggtcggagtgaatatgagcaggcagtaaaagaggcggaagaccagatctcggacgggcaggaaaagatcatagatggagagaagcagctgacggatgcaaagcagcagattgcagacgcaaaggctgagatcaaaaaaatcgaaaatccgaagtggtatgtgcagacgagagaggatgcactgacggaatatcaaggatacggagataatgcagaccggatgcgttccattggaaaagtatttccggtactcttcttcctggtggcagcactgatcagtctgacgacgatgacacgaatggtagaggagcagagagtccagatcggaacgatgaaggcactcggttatggaaaagctgcaattgcaggaaaatacattggttatgctctgattgcaacgcttggcggaagtattttcggagtactggccggggaaaagatcctgccgtttatcattatttatgcttatatgatcctgtataagcatctgccggcgatcctggtaccgtaccatatgagctatgcactccaggcttcgggaattgcagttgcctgcacactgatcgctacgatcgcatcctgctacaaagagctggcagcagaaccggcagagctgatgcgtccggcagcaccgaagcaggggaagcggattcttctggagcggatcggaattatctggaagcatctgaattttacatggaaatcgaccgtgcggaatctgatccggtataagaagcgattctttatgaccattttcggaatcggaggctgtatggcactgatggtagtcggattcggactgaaggactgtatctatgagatcgtcagcctgcagtatgagaaggtgcagttctatgatgcggcaacctacatgagtgacgacatatccgaagagaacagacaacagctccatgattatctggatcagaatgcagatataaaagagacgatcgaagcgcggatgcagaagaccgatgtaaaatctgcatccggtaaaaagacactttatctgatggtgccatcggataatgaaaagattaaggactttttaagcttccacagcaggaccaataaggacgaggtttattcactgaaaaaagacgaagtgattctgactgagaaaatggcatcccttctgaatgtaaaggtgggagatgagcttacaatcgaggacgaggacaggggagaccagacggtgacggttggcgccatctgcgagaactatatgagccattacctgtatctgtcaccggaaaaatacgaggaattatatggtgtaccggcagaatataacacgatcatctacagtgtaaaggacggaaaggatgatcagatcgagaagatcggaacaaagcttctgtcgatggatggagtactgaatgtaagttataccagcagtattgaaggaaggctggatgacatgctgcgaagcctgaatctggtcatcgtggtactgatcgtatctgccggaatgctggcatttgtggtactgtacaatctgaacaatatcaacatcaccgagcgtcagagagagcttgcaaccttgaaggttctgggattctacgacggagaggttgcctcttatgtatacagagagaatatcctgctgacgatcattggatcggttgtgggtatggtgcttggtaatctgcttcaccggtatatcatcctgacggtcgaagtagaagaggcgatgttcggacgtcagatacactggcagagttatctgtacagtttcttgtttactgtagcattttctttatttgtaaactgggtaatgttctacaagctgaagaagatcgatatggtggaatctttgaagagcgtggagtaaaagcttttgcaagtgtatgtcaaagatttcttatagacggtacacaaagaatcggaaaatatatttcacagaaagtttatattcttcacagaattattagcactcttgtcaaaagagtgctaattttctattgacatttagaaatcagggtattaagatatttcatagacagaaaaatacggtatttgaaaccgtaaaaagatagaatatgaaatttaggagtgataaaaatggcagcaaaaaaaggtagtctttcaatcagcagcgaaaatattttcccgattatcaagaaatgggtatattctgatcatgatattttcgcaagagagcttgtttccaatggatgcgacgcgatcacaaaattaaagaagctgggcatgatgggagaatatacacttccggatgattataaaggaaagatccaggttattgtaaacccggaagagaagactttgaaattcatcgataatggtcttggtatgactgctgatgaagtagaagaatatatcacacagatcgcattttcaggagcaaccgaattcctgaacaaatacaaagataagacaacagaggacgatatgatcggacactttggtcttggattctactctgccttcatggtagctgatgaagttcatattgataccctttcttataaagaaggtgcaaaaccggtacactgggtaagtgaaggcggtacagagtatgagatggaagaaggggataaagaggaagttggttctgaaatcaccttattcctgaacgaagattgtgtagaattttcaaatgaatacagaatccgcgaagtccttgagaaatactgttcattcatgccggtagagatttttgtatccaaagcaaatgcagaaccggaatatgagacgatcccggaggatgaagtcctggataccgatacggttgttgaacatatccatgaagacgccaagatggaagaaaaagaaaatgagaacggtgaaaaagaaatggttgaagtttcaccggcatccgacaaagcaaagatcgtgaaacgcccggtatcgatcagtgatccggcaccgctgtggacaaagcatccaaacgaatgcagcaaagaagattatattgatttctaccggaaagtatttatggattacaaagaacctctgttctggattcatctgaacatggattatccattcaacttaaagggtatcctgtacttccctaagattaataccgaatacgattccattgaaggaaccatcaaattgtacaacaatcaggtatttatcgcagacaatatcaaagaagttattccggaattcctgatggtattaaaaggagtcattgattgtccggatctgccgcttaacgtatcacgaagcgcactgcagaatgatggattcgtacagaagatctccgaatacatttccaagaaagttgctgacaagctttcaggaatgtgcaagacagataaagaaaactatgagaaatactgggatgacatcagcccatttatcaaattcggctgcctgaaagatgaaaaattctgcgagaagatgagcgattatgttctgttcaagaacctggatcacaagtatatgacactcaaagaatgcatcgaaaaaaatggcggaaaagcagaaccggaggaaaagactgagggtgaaaatgcagagcagtcagcagaaaagaaagaaacagagaagacaacaatctactatgtaacagatgaacagcagcagagccagtatatcaatatgttcaaaaaagagggactggacgcagtgatcttgtcacataatattgattctccatttattacacagatggagcagaagaacgaacatatcaagttccagagaatcgatgcagatctgactgatcacttcaaagaagatgtatctgaagaagaaaaagaagcattcaaagaaaaaactgacagtctggtcgaaatcttccgcaaagcacttggcaatgacaaactggaagtaaaagtggaaaagatgaaagatgaaaatgtggcatctatgattacactttccgaagaatcacgccgtatgcaggaaatgatgaagatgtatggaatgtcaggcatggatccgtctatgttcggaaccaatgcaaccctgatcctgaatgcaaatcatccgctggtagaatatgttgtagcacataaagatggcgaaaatacagaaatgttctgccatcagttatatgacctggcaatgctggcacacaagccactcagcccggaagagatgacagaatttgtgaaacgcagtaatgaaattatgatgaaattggcaaaataatcttgctgtagatacccggaaaagcctgaaccatttagattcccattttcgcttatgcgaaaaggtctgaatggtcaggcttttttgctgtatttggaaatacttttcacaaagtgttggtgaacttcctggtcttttatagtataatataacaaaagagaggcggtggatacgatgaagaattattcaaaggatataagcagacaatatcatattcaggtggccaacggggaagtcggccgttatgtcattctcccgggagatccaaagcgctgcaaaaaaatagcacagtattttgaagatccggtgatgattgcggataaccgggaatttatcacttatacaggaactttagatggcgtaaaggtaagtgtcacatctaccggaattgggggaccatcagcagcaattgcgatggaagaattagccagatgtggagctgatacgtttgtacggattggaacctgcggtgggatacagccggaagtaaaaagtggggatattgtagttgctacgggtgccgtcagaatggaagggactagcaaagaatatgcgccgatcgaatatccggcagtggcagaccttatggtggtgaacgcactggtcagtgctgcgaaggaaaaggactgtgaattttataccggagtggtacagtcaaaagatgcattttacggacagcatgagccggagatgatgccggcaggttatgaactgatcaataaatgggaagcctggaagaaactgggatgtctggcatcagagatggagacggcagcactttacattgtggcagcaaagcttcatgtacgcgtgggtgcgtgtttccttgtaatggcaaatcaggaaagagaaaaactgggacttgaaaatccggtagtacatgatacagatatggcagtacaggtggcagtggaagccatcagaaagttgatcaaagaggagcggtaaatgaaagaaacaatatataaacgaatctttgtgatcgttctggattcgctcggaattggtgcaatgcctgattctgagaaattcggtgacagggatgtagatacatttggtcatattttagacagaatgggaacactggagattccaaatcttcagaagcttggtatgctgaatctgcataccgggggaaagatgtatggaatcgagaatccgattggaaaaattaccagactgaaagaggcgagtaacggaaaagatacgatgaccggacactgggaaatgatgggaatttatacagaaaaaccatttaaaacctttaccgaacatggatttccaccggaactgatcgcagaactggaaaaacgttgcgggaaaaaagtgattggaaaccgtagtgagagcggaacaaagatcattgaagaacttggggaagaagaaattgaaacaggtgcaatgattgtctatacctctgcggattctgtattgcagatttgtggaaatgaagagacatttgatctggcaaatctgtaccggtgttgtgagatcgcaagagagatcacgatgaaggatgaatggcgcgtgggacgagtcattgcaagaccgtatgtaggaaagaaaaaaggtgaatttaaaagaaccagcaaccgcagggattatgcacttgagccgaccggaaagactgcacttgacgcactgaaagatgcgggaaaggatgtgatcgcagtcggaaagatccatgatatcttttgcggggaaggaatcacagaatcgtatcattccaacagctccgtgcatggaatggagcagaccattgagatttgcaaaaaagattttgacggactgtgctttgtaaatctggttgattttgatgcacagtggggacaccggcgcgatccggttggctacggacatgagattgagagatttgataaaaatcttggaattttgctggatgatctgcgggaggatgatcttcttattattaccgccgatcatggaaacgatccgacctacacaggaaccgatcatacacgggaatatgtaccgtttttggcgtattccaaaaagatggatgagggtggcgtgattatggagaaaaatacctttgcagtgatcggggcaacggtcacagataattttggtgtaaaaatgccggaagggacgatcgggcattcgattctgaatgaacttatttagcaagaaaaagcaggaaaaaagagaatgaaaaaagaacaaattaaaaaaatgatagaaatcgcgctttctcagcttgcatattcttataccccttattctgactttaaagtgggagctgcgctgcttggaaagaatggacggatatatacgggatgcaatattgaaaatgcggcttatacaccgacaaactgtgcggagcgtaccgcgtttttcaaggcagtcagcgaaggagtaaaagaatttgatgcaatctgtattgtaggaggaaagggcggtgttgtgacagagtatgcaccgccgtgcggagtatgcaggcaggtcatgatggaattctgcgatccggagacatttcagatcattcttgcagtagatgcaaagcattatgatatctataccttgaaagaaatgttgccaaaaggtttcggaccatccaatcttacagaatgagaaaggactcagactccaaaagaagatttttgaagaaaaggaaaaagagaaggaatgaaaaatgacacaggaaaccttgaaagaattatcgaagattgagcttcactgtcatctggacggttctcttagcagatcatttattgaaaaaaggcttggaagaactgtaagacctgaagaactcagtgtttcagaaaactgtacaagtctgaatgaatatctggaaaaatttgaccttcccggcagatgtattatggatgaagagggactttccggagctgcgtatgatctgctctcccagatgaacgaagaaaatgtctgttatgcggagatccgttttgctccacttctgtcagagacaaaaaagatggacagccggaaggtgatcgaagcagtaatcagcggaatggagcaggggaaaaaagattttggaatcgagtatggtgtgatcgtctgtgcaatgcggcatcacagcactgaggataatatgcggatgatcaagacggcaagagaatatctgggatccggagtttgtgcagcagatcttgcaggagcagaagcattgtatccgatgtctgaatttatggatatttttacagagacaaagaagatgggaatgccatttacactccatgccggagaatgtggaaatccacagaatgtcatagattcgataaacgtgggagctggaaggatcgggcatgggatcgcgatgcgtggcaaccaggagatccggaaaatggcaaaaaaagcaggtattggtatcgagatgtgtccgatcagcaatttacagaccaaatctgtaaacagcatggcggaatatccgatgcgggaatttctggatgcaggcttaaaagtatcggtcaacacagataaccgaacggtgagtaacaccagccttacgaaagaactggaatttattcagaaaaattatggaattcgggacgaagaaatccttcagatgatgaaaaatgcaattgatactgcatttgccgatgattctataaaagataaaatttgcaaaatgctgaaataaagaaactacaaacagagaggattgactctgaaaaataatagaaaagaggaattctgtatgagcaatgaaatttatgaaaagctggaaatatgccggaaaagcattctccaaaaaacgaattttaaaccggaagtggcagtgattctgggctccggtcttggcgaatacgcatcaaaaatcaagatagaacagatcattccatatacagaaattgaaggttttccggtgtcgacagttgtgggacataaaggacaatttgtatttggttatgtaaaagaagttccggttgtgatcatgcagggacgtgtgcattattatgaagggtatccggtaacagatgtggtgcttccggtgcggctgatgggaatgttaggcgcaaagaagctgattcttaccaatgcatcaggcggaatcaataccggattccatccgggcgatctcatgctcatcacagaccagattatgagtggaatccctaatccactgatcggtgccaatgtcgaagaacttggaacccgttttccggatatgagtgaagcctatagtaaacggatgcagcagatcataaagaaagaagcccaaaaactcggcattcctctgaaagaaggtgtataccttcagcttaccggtccatcttatgaaactccggcagaaatccgtatgtaccgcacctgtggggctgatgccgtaggcatgagcaccgcctgcgagacgatcgctgcccgccacatgggaatcgaagtctgtggcatctcctgtatcaccaacctcgccgccggcatgacatcacaacatctgaaccaccaggaagttcaacaaaccgccgaccgggtggctgagcaattccaggaattactgacaggaatcattacccacgtataagaaacggaacatatatctgaatttacccagaaccaggtccaaggttccggattttccggaacccgccgaccgtcctcttgcaattccgagttgaggcattgtgtaagaattttgccaacgagatagaaagacaaagagcataaaataccgcatacagtattttatgctctttgtctcaccactattttcaaaattttactcaacctcaaacggaatctcgtacttcgcaaaaatccgctgcgccatcttgtcccatgcctgctccagtgatttgtccagcgtgaacaggttcatagatgttcctgtcgtacagctaagttttgtcccgtcatatttaaaattcaggtacagtccctgcacatctgccggagcaaatgaaagatgttcctgttcgagaagccgtgcaatattcggtgctgacatagaaagaacaaaatgaaatcccagcggagtacgctttcctttgatcagagaaaggcaaaactcgcgaagttccctccagagagcatattcccggtcatccagagcttctttttcttcagcactgaagaaatcttttttcagtcgtccgttaaattgaaaggtattaaaagttgtgatatctccttcaataaataaaaaggaatcaaatgcaggatgcagtaaaagtgcgttcatgcatttttttgtatccagagaaaaaataagcatagacttcctcccgtcatcagtgtaatagtatcagtatagcataaatcttgagatatgcataagaatttgatacaatacgggaaagaaaaaggatggataacaagatgaaaatagaattaaaccgggatcagatcaaatacattgcagtgtttactatgctgctcaatcacgttgcaaatatatttctgcaaccaggaacctttgcctgcgaagcactaaaggatatcggttattttacagcaccggtcatgtgctggtttctggttgaaggataccgttatacaaggtcagtaaaaaaatatgccggaagactgctgatctttgctgtcatttcacagcttccgtattatctggcatttgcgcggaatcatctggcaccgtggtatactttaaatatgatatttacactttttctgtgcctgtgtctgatgatcgcagaggaaaaaatatcagatccgggaaagaaaagtctggttgtattgggaattatagcagtaagcagtatctgtgactgggcaattctggctccattgtatacgctttggttttaccgggcaggagaggatccaaagcgccggaaaaaggctttttttattgcagcacttgttctggggattacggtgacagcagaacttccgggagctgcaggaatcgcagctggagcaggggcaatgattgcagtactggcagcgggaggctgtgttttggtattttataacggaaaaaaatcacagaaacattttcttgtgaaaaagtattttttttacgtgttttaccctgcacatttggtgattttggcattattaaagatttgacttttataatagaagaaagtaaaataaataagttagagtatttatcacatgattcaatgaaaatggaattcatattttaataaaagataggatgcatagcatgaagaaaagaacgatggagaaagaacatcaggcagaagaaagaagaaaaaaagttctgatggaaattgcaggagcggttgttgtactgactgtaatcgtaagtattggtctttcgcatcttggaacagataaggtgaatacatcagcaggagtaaaagcaatcaagaagctggaaaaagcagatgtatctgaggtggagaccaaaatttcaaatattgagaaagaagaaaaacaggcgacagaggactggcagaaccgtccgttgtccgaaaaatttgcgcatgcggtgattctcggagattcgatcacaaccggttttaccgtatatgatgtgcttgatacttctaaggttgtagcggaaaaaggaatgcaccttgatcagaccggtgatctgatcaggacagcagcagagttaaagccggaagtcctctttctggcacttggactgaatgacatttccggaacagatggagatacagatgcatttattgaaaaatacaaagcggtacttgcaaatgtgcgtgagcagatgcccgatgcagtgctctatatcaactgtgttcttcctgtttccgttcaaaaagaagaagaagagccggtttatgccaagattccggattataataccgcacttaaagcaatgtgtgatgaagaaggaattacatttatcgataatacagagatcgtaaaagatgagtattatgagcaggatggcgagcatatgaaggcggagtattatccaatctgggcagaacatatggcggaggtggccggaatatgacaaagaaaaaaggggaatttacagttctgcgtaatatcagagctgggatggtaattattttgcttatctatatcggtctgatctttcagtctaagggagacagcgatacaccgtttgcagatgtacagaaagcggttgtggatgcggcagatgacaagaacatgacacttgccggaacccaggagatcaagagattctatgggatcaatccaaaggattatgaagatataacactgtattatacgaatgaaacaatgggagtcaacgagctccttctggtgaaaacaaaggacgagaatgaggcagaggcagttgagaaagccgcagaacagcgaaaaaagacacagctcgataattttgaaggatatggggccgagcaggtaaagcttctggatgcttcgatcattaagacgaaaggtacatatgtgctttttgttatttcaccaaaagctgaaactgtagaaaaggcgtttacaaagagcctgaagtagataaaaggaaacgaaaaagttatgttatttagtagtctggtatttttgtttacatttttgccaattacactgttggtatattatttggtgccgcgtaaggtaaaaaatgtggtacttttgatcgcttccctcatattttatgcgtggggagagccggtctatatcttcctgatgctgatttccattctgttcaattatttttgcggaatggacattgcattaaaagcaggaagaaaatcgcaggtgcgcagtctgatctttacgatcgttgtaaacctgtttattcttggatttttcaaatattacggatttatcgtgacaaatttaaatgcgatccttccgttctatattccatatagaaaactggagctcccaatcggaatttctttctatactttccagacattgtcttacatcattgatgtatataggggaaatgtagacgtacaggtaaatctgattgatttcggaacctatgttacaatgttcccacagctgatcgcaggtccgatcgtacagtatgcagatgtggagagacaactgcgtgaaagaaaggaatcactgacgaagtttggatacggtgcctggttctttgtgataggactggcaaagaaggtgcttctggcgaatacgattggttcgatttatgaaaatatcgcggcgatggatggaatgtcagtagtgactgcatggcttggatgtcttgcctacactttccagatttatttcgatttcagcggttattcggacatggcagtcggacttggaaagatgttcggatttgagtttatgcagaacttcaattatccgtatatttccaaaagtgttaccgagttctggagaagatggcatatttcgctgggatcatggttccgcgagtatgtgtatattccgcttggaggaaacagggtaacggttccgcggcatttactgaatcttctgatcgtatggttcctgaccggtctctggcatggggcaagctggaactttgtagtatgggggctcttctacggagtgatcctcattactgaaaaatattttacaggaaaaatacttgcaaagctgccggaggcagtccagacactttacacaatgattctggtcatgctcggctgggtactgttcttcagcccgacactcggaagtgcacttacctggatcggcaatatgttcggacagggtgcaaccggatttatggacagccaggcattgtacctgatcatgcgaaactggctcttctgggtggcagggatcataggaagtacaccgtttatgcatctgctcggaaagcggctggtatttaatgaggaaagaccgcatacggttctggcaggctgcctgatgacaggactgtttgtgctgtgtgtggcatatctggtgacagaaagttacaatccatttttatattttagattttaaggaaagacaatggtagaaggaaagaataataaacaaaaaaacagaacaaagtattttctgccaggagggaaaaaacagatccaggcagtatgtgcgtttttatttctgggagtccttattctcagctgcggagtaaaccttatgcataaagacaggcagatgtcagaaaaagaaatgcgtatgctggcgcagaaaccggaaatttctctttccggaattgcttccggaaggtttatggagcagtacgaggagtatgtatcggatcagtttgcaggaagagatacctgggtaagaatcaagacatttgcggacagtgtggcggggaggacagaagaaggtggtgttttcaaaggaaaggatcattatctgatggaagatgttgctgtggcagatgaaagtgatctgaaagagaatctggatgcaatgaagaattttaaagagcgttatccggatatccagatgcatatgatgctggttccgaatgcggcaaatgttatggaggacaagcttccggcatttgcggtgactgccagtcagagcagacagatcagccgtgtaaaggcagaacttggagattcttatgactggatcgatgcagaaaaagtactggatgctcacaaggatgaagcaatttattatcacacggatcatcactggacttctcttggtgcatggtatgcattccagggagcaaagacacagcttggactggataagagtgaagaaattaagatgaaagcctatgcggtatcggattcttttaacggaacgttatccgcaaagagtggatatgagacagattataaggaaccaatctatatttatctgccaaagagtgcggatgcaccacaggttgcagtcaattatgtggaagaacagaaaaagagtgcttctatgtatgattcatccaaactggatgagagagatcaatattccgtattcttcggtggaaatcatgcaatgatcgatatccagtcaacacagacagaaaaacgcagacttctggtgttcaaagattcatatgcaaactgttttcttccgcttctggctccgtattaccgggaaatcgttgtgatcgaccctcgttattataccggtaaattaagttctgtgatgtcagataaacagtttgatgatgtgctgttcctgtataatgccaatacattctttgaagatcggatgctggcgggggtactggatgagaattaacaggagaaaaacatggcaaataaaatagaaaagcagtttctggacacggaaaataaaggaccggtccggctgaacaaatatttaagtgaagctggtgtatgttccagaagggaagcggataaactgatagcagccggacaggtgacggttgacggtgtgcgtgcagagaccggaatgaaggtagagccgtggcaggttgtccggattgggaaaaagcaggtatccagacaggaagagatgatcgtgcttgcggtcaataagccgcgtggaattgtctgtactgaggaaagacgggagagagacagtattgtacgtttccttaactatccggtacggattacttatgtaggacgtctggataaggattcggaagggctgcttctgatgacgaacaacggcgacattatcaaccggatgatgcgtgcggcaaataaacatgaaaaagaatataaagttacagttgataagcccgtgacagatgaatttctcaaggagatggcaggcggtgtcccgatcctggatactgtcacaagaccatgccaggtagaaaagcttggaaaatataaatttaagatcattctgacacagggactcaaccggcagatccgccggatgtgtgaggcacttggctacgaggtaaaggagctgcggagagtgcggatcatgaatatcgaacttggtaatttaaagccgggagaataccggaaggttacggatcaggaactgaatgaactctatgagctgatcagggattcaaagtcagagccgacaccgtggaacaataattaaaagtgtggatttggatatggataagatgaaaaggatgcaggagctggtagagcttctgaataaagccggaaaagcttattatcaggatgcgcaggaaattatgagcaattatgagtatgatgcgctgtatgatgaactgaaaggtctggaagaagagctgggaaccgttatggcttccagtccgacggtgaatgtaggatatgaagtattaagtgagcttccgaaagaacgtcatgagtcaccgatgctttctcttgacaagacaaaagaagtggcaaggctgaaggaatttgtcggagaccagatggctgtgatctcatggaagatggatggtctgacgatcgttttgacctatcgtgacggcgaactttttaaggcagttacaagaggaaatggggaagtcggtgaggtcattaccaacaatgcgaaagtatttaaaaacgtgccgcttcatattccgtataaaggggaactgatcctgcgaggggaagcagtgatcggttacaaagattttgagcggatcaatgaagaaattgatgacgtggatgcaaaatataaaaatccacggaatctgtgcagtggttctgtccgccagctgaacaacaagatcacggcacagagaaacgtaaaattctatgcatttaccctggtacgtgcagaaaatgtggatttccacaattccagaaaagaacagcttgactggctggaacatcagggatttgatgtggtggagcattatctggtgacaagggaagaactggatgagaaggttgcattttttgcagaaaagatcatagaaaatgattttccgtcagatggtctggttcttgtatatgatgacattgcgtatgggcagtcgcttgggagaacggcaaaattcccacgtgattcttttgctttcaaatgggcagatgagatccgcgagacgcaccttctggagattgaatggagtccatcaagaacagggcttattaatccggtagcgatctttgaaccggtagagctggaaggaacaacggtaagccgtgcaagtgtacacaatttaagtattatggaggagctgcatctgggaatcggggatacgatcgaagtctataaggcgaatatgatcattccgcagattgcaaagaatctgaccggcagtgataatattgagatcccgaaagtctgtccggtttgtggtggagctacggagatccgtcagatgaatgatgcaaagtcgttgtattgcacaaatccgatgtgtcaggcaaaaagaatcaaatcctttgcattgtttgtcagcagggatgcactcaatattgacgggctttctgaggcgacactggagaaatttattgcgagaggattcattcacaaatacagagatatcttccatctggatttctatcaggaagaaattcagacgatggaaggctttggagaaaaatcctatgcgaacctgatcgcaagcgtggataaggcgagaagcacaacacttgctaaagtggtatatgggcttgggattgcaggaatcggtctcgcaaatgcaaaactgatctgccgccattttaaaaatgatgtggaaaaaatgacaggagcatctgaagaagaactgagtgatatccaaggggtaggtccggtgcttgcggcggcatttgtaaaatattttatatcagaggaaagaaaaaaggaatttaagctccttctcggagaactggagatccagccggaagagatggcagaggaacagaaatttgcaggtatgagtttcgttatcactggcagcgtgaatcattttgcaaaccggaatgaggtaaaagaactggttgagaagatgggtggaaaagtgaccggatctgtaacgaagaagacaaattatctaatcaacaatgatgtagagtctgcttcttccaagaacagaaaggcgaaagaacttggagtgccgatcatttcagaggaagagtttatagaacttgcaggggtggaaatcgaataagaaggacagaggaatctgtctgaatacgaccgagaaaaggaggaccagccaatggcagaaaatgaccagaaggacaagacagttgagaaagtaaccggtgaggtagaaaatacagacaaaaaagaaaataacgaagatcgctatgaaaaggtctgcttcatctgtcacagaccggagagtgtgaccggaaagatgatcgatcttccgaacaatatctgcgtgtgtccggactgtatgcaaaaaagctttgatgcaatgaacaatataaattttggcgggatggattacagccagtttatgaacatgggaccgatgatgggatttggagacatggatgcacagatcccgaagagccagcgtgtgaaaaagaaaaagccggaagaagaaaaagaaccgatcctgaatatcaaggatattcctgctccgcataagatcaaagcgaaactggatgaatatgtagtaggacaggaatacgccaagaaggtaatgtcggttgctgtatacaatcattataaaagagtggcaacggatacaatggatgagattgaaatcgagaaatccaatatgctgatgatcggacctaccggctctggaaagacgtatctggtaaagacactggcaaaacttttggatgtgccgcttgcaattacagatgcgacctctcttaccgaggccggctacataggggatgatattgaaagtgtagtatcaaagctccttgcagctgcggacaacgacgtagataaggcggaacagggaattatctttatcgatgagatcgacaagattgcgaagaagaagaataccagccagagagatgtcagcggagaatccgtacagcagggaatgttaaagctgttagaaggcagcgaagtggaagtgccggtaggagccaatagtaagaatgcgatggttccgctcactacagtcaatacaaagaatattctttttatctgtggcggtgcgttcccggatcttgagcagatcatcaaggaaagactgatgaagaattcttctatcgggtttggagcggatctgaaagacaaatatgatcatgataagaaaatactggagaaggtgacgacagaagatctgcgtaacttcggaatgattccggaatttctgggacgtctcccgatcgtatttacgcttcagggactggatgaagagatgatggttcagatattaaaagagccgaaaaatgcgatcctcaagcagtatcagaagcttctggcactggatgaggtcaatctgaaattcgatgatggtgcacttcatgcgatcgcaagaaaggcaatgaagaaggataccggagcccgtgcactgcgtgcaatcattgaagaattcatgctggatattatgtatgagattccgaaggatgacagcatcggggaagtgacgatcacggaggcatatatcgaaggaaccggaggaccgctgatcgagctgagaagccagtctgtaccaaggcttgagcatcactgagtataacaataaccttcatatatcaaaaaaacatggcgatcatacaaaaatagaatgggaaatatccgtaaatttaagatttacgggtatttttttgttgaaaaattgtattaaaaggtgtacattagacaatgtgtctaaaaaaacaagatataaacaggagtgagagagaatggagacttataagtatttactggatcttgcaattattttactttgtactaaagcacttggtcttgcgaccagaaaggtacagatgccacaggttgtaggggcacttcttgcaggagttcttcttggaccggcgatgcttgggatcttgacagagacaagctttatacataacgttgcggagatcggtgttatcgtgctgatgttttgtgcaggtttggaaacggatatacaggaattgaaggcaagtggaaaagcatccttcgttattgcactgataggtgttatcgttccactgatcggcggttatgcgactgcaatgttctttaaccgtccggatgtgatcgcatccgatgcatcctgcaacgtatttctgcagaatatctttatcggtgttatcctgacagcaacttccgtaagtattacggtagagacattaaaagaacttggtaaattaaaaaccaaatccggaaatgcgattcttggagctgcgatcattgatgacgtgcttggtatcgttgcactgacactggtaacaagtatggcagatgaatcggtaaagatttcagttgtattactgaagattgttgcattctttgcatttgcaggtgtgattggatttatcttttacaaggtatttaaaaagtggacagatcaggcggaaaagggactcagacgtcatgcgatcatggcatttgtattctgtctgctgatggcttatgtggcagagaaattcttcggtgttgcagatatcaccggtgcatttatcgcagggctgatcatttctaatacaagtaaatctgatttcgtgctgaagaaatttgatactatgtcttatatgttgctttcaccggtatttttcgcaagtatcggactgaaggtagaacttccgaagatgagtactgcaattgtaggctttgcagtggttcttaccattgttgcgatcctgacaaagatcgttggctgtgcccttggtgcgaagatgtgtggatataagaattatcagtgtgcacgaatcggtgtcggaatgatctcccgtggtgaggttgcgctgatcgttgccagcaagggagaagcactcggtatgctgggcggcaatttcctcggaccggttatcatcgtggtagtgatcacaacgatcatcacaccaattcttctgaaaatcgtattcaagagtggtccgaatgtaagtaccctggaaaaaggaaaagaagtgacttccttctacgaggatattgaaaagaaacgtaccgaataaagaatggatatggagtgcaaaatgcgtaaccgtccagtatcatagtaataagaaagaaaaatccctcatatattttccaaaagaaagtatatgagggatttttatgctacaggaagaatgtaaagaaaagatcctgtcagaagaatacagggattttatgatgagggataccggtgctcttgggaaaaactttcctttggaaaacggatgccggataccgttgaaatacggttttgagcttttttatattgaccagagtgaagacagaaaaaagtcacttgccgattatccttatacaatggttccgaagtgttatacaacactggatatggcagcaatccagcaggcgggaattgctgcggttcagaatatacctggtctggaactgagtggtgaaggagttctggttgggatcattgatactgggatcaactatctggatcccattttccggaatctggatggttcgaccagaatccagcgaatctgggatcaggaagaacaaagtggaacagcgccacgggaaatcggatatggaagtgaatatacgaaggaacaaatcaatcaggcaatcctaagtgagaatcccaaggaaaccgttccgtcatttgatacggacggacatggcacttttgttgcaagtgtggcatgcggaggggcaaatccggagaatctgtttatcggggcagcgccggaggcagagatggtgatcgtgaagctgaaagaggcaaaagaatatttacgggagtactattttgtagaccgggatgccggatgctatcaggaaaatgatctggtagcggcggttttttatctgcagaaggtacaagaagagctgaaaagaccattggtgatctgtctggcagttggaacaagctttggaggacatggaggatattcaatcctgtcagagtatctgcaaaatgtagcggcgagcgaaggaatcgggattgtgaccggaagtggcaacgaggcagataaaaggcatcattatctgggaattctggaacaggaaaataatctgccggtcgagattaatgtaggaaataataccagaggttttgtgatggaactatggacagaacttccgaatcttctggctctttctatcgcatctccaacaggacagacagtaggaccgatctcgctcaaacggggaataggagagtatgtgtttgtattcgagcagaccagggtaatatttaattaccgggttctggtagagacgaccggggcgcagctggcattttttcagtttgaaagaccgggaagcggaatctggaagattataccggaaacactggagctggggaatggaatctttcatatctggcttccaatggaagagtttctgacgggaaatgtctattttatccgtgcaaatccggaatatacggtgatggaaccaggggataccggggcggtggtctgtgcagcgtactataatggaaaggaaaatagcattgcagtcagttcgggaagaggttatactagagataacagaatcaaaccggattttgctgcgccggggatcaatgtgacagggatcaatttaagggggcagtttgttgcaagatctggttccagtatagcagttggaatcacttccggagcactggcactttttatggagtggctggataggcatggagtgaatctggatgcatcacagatgaagaatctgctgatattgggagcttcacggaagacagacatgaattatccgaaccaggaatggggatatggagcattgaacctttaccgtacttttgagcagatcaggcggttctgaaaaatacgcagatgcgaaaggggaaaaagtaaatgagtgatttttttgatacaataggaaagcggatttcagataccgtggatgatcttggaaagaaggcaggagatacgatcgatattcagaaaaagaaaaatgagatctatggtctgaagcgagacagcgagcgggatatgacagagatcggacgattggtatatgagcgtttcaaacagggggaagtggtagataccgattttatcgcactctgcgaagcaatcgaaaagcgtgaagaacagacagaggtatgcgagcaggaaatcgcgcgcatcaaaggagaataattatggaaatcctgagcattttaaccggagcttttgttgccgggtgcgatcttggaattaaaaaatatactgaagaaaatgtaagagacggggaagaacgccggatttggaagggaaaaggaatctaccgcaaagtccacaacaaaggtctgatgatgaatcatttggattgcagaccaaagctggtaaaaggcatgtcggcggcagcacttggaatcctgtttttctgggagcaccttctttggaaagaaccgggacgcaaactggcaaagcttggaacatcgctgatgctgggcggagcagttggtaatacttatgaccgtttcaaaagaggttatgtggtcgattatctgtctctgaaaacaaagaacaggaaactctcggatatcacttttaatctctcggatctggctctttttgcaggagcgatcctgacggtatggagttctttatttggaaaaaagagataaaaatgattcaatgtatctgaaaaaatacttgactgtttttaaagagttgaggtattataaaccttgctgatatggcgttgtctggcatatgccatatagaaaaaagaatagaatctcggttatattggaaacgatacattcctccggaatgatgaacgaacaacacattttctgttacgcttattatgaaggaggatatttttatgccaaaaaacaaatttcaagacgttattttcacaattatcatggtgttcgtgatggtttataccatgatctgttacaacattgctctcaacgtaggaggaatgaacaaccaggtatttttaaatgcattccacgagctggtcattatgggaccaattgcattcatccttgattttttcctgatcggaccatttgcaaagaaaaaagcattttccattgttaatctggaaagagataataactttcacctggtgatcgccatttccgtagtatccatcatcggaatgtgcccacttatgagcctcgcagcaaccctgctcttcaagaatgcgggaacccagttcatatccgtctggttccagaccacagcaatcaacttcccgatggcattcttctggcagctctgcttcgccggtccactggtaagaaagattttcacattattattcccagaaaaagaaacatccaaaatcgctgatggtcaggaagcctaattgaggtaaagtgtaaatccatttgaaaatataaaacaatgatttacggctccagttcaacacccagtcaaagaagtaaaactcagtcaacaacgtaaataaaaaataatccctggtagctgcgtctttgcacgatggaaacgagacttaatcaattgtggaagccattgctgacacaattgatgctttgaaaggctcgttggaatggttcgtgcaacttagcagctaccagggattattttttatgccctcttgcgactacccctcaagttctttcaacactttcctaaattgaaacgtaaacaaaaccgtcgtgaaagatacagccaggaagtctgcaatcggttcagccatatacactgcattggtcttgttcccggtcagaatatgcggcagcagatagatcagtggcagcaacaggataaatttacgtgtaacagcgacagcaatcgaagcctttgcttttccgaatgatgtaaatgccatctggcatgcgatctggattccgaaaagcagcaggcaggcacagtaaatccggagtgctgatttagtaaaaccaagcagtgtagaatcggaagtaaacatttcggcaaacacctgagggaagagcataataaatgcccacagaattgtggaataacagaggcttgctgttaaaagaagcctgaaagctttttttacacgatctctgttttttgcaccgtaattatagctcaggactggttgggcaccctgtcccagaccctgcagtggcagcattgcgaactgcatgacactggtgaggattgtcatggcaccaactgcgatatctcctccgtatttcagcagagaagagttgaaacatacagagatgatactctcactagcctgcatgataaatgtggcaagcccgagagcgacacaaggaagaataatctccggtttcaggatgagattctttttccggatgtgcaggatcgtcttttttccgcaaaggaaagaaagaacccagatgcaggagactgcctgtgacagaattgtggcaagcgcagcacctctgacacccagatggaatgcaaagataaacagcggatccagaacaatgttcatcactgctccgatcagaacagagagcatacctgttttggcaaaaccctgtgtggtgataaacatattcatgccaagggtaagctggacgaaaatagtgccgacagcgtaaatgttcatataatttacagcgtattcaatcgtattttcactggcaccgaaggcaagaagaaaagtacggttaccaaacagcaggatgactgtcaggattatagaaatcagaatctgcaggaaaaagcagttacccagaatatgttctgcagtattaagatcattttttcccattgcaatcgaagcatgcggtgcaccaccgcctccaaccagtgcggcaaaagcggaaatgatcataatcagtggcatacatacgccgactccggtaagggcaagtgccccattaccaggaatgtgtccgatgtaaatacggtcaataatgttgtacagcatattgatgagctgtgcggtgatcgtcggaagtgccagccggaacatcagctttccgacgggttcagtacccagaaaatctttgtctttgttcatgtctaataatctcctttgtgataaatagttgctacgttggatgctagacgttcattcagcgaggcgaacatctggaattcttctaatgaaaatccgtcaaacagattgtggtaaaaagcagactggaacgtgtcgattgctccggtaacattttcgcatgatggcagcagggaaagatgcgttttcctgcgatccgtctggtctgctgtttttgaaagaagtcccttctgacataaaagatcaactgcctgggatacattccctttcgagagcatccgtagctcgacgatatcacctgcggtatcttttgtggggttattatgtaagaaagcaatgatcttagcctcgatcagcgagagatcatactggcggcataattctttcaacatctgttcatgcattttcccaattcgctgcattaatacaagtaggtctgtaatgttcatctatacacctccgttttttttataaaaatgttctaaaaagaacaatttagataatatcttatatccattgagataaaatgtcaatagaacgaaaatatgcaagttatttgttaaatataaacggtataattgtatacgaaaatacatttttttactttaacatattgacgtggagaaaatttgctgttacaataataaacaatttatagaccatagttcaaggaggacataagtacatgcttacaggatttaaaaacgcagtagaagttgatttcacattggaagaaaataaaaagaaaatagaagaagcattcaaacaggctcatgcagaagcaggtgctgtttacccgctgatcatcggtggaaaaaaagttgagacagaaaagaagatcgcttctgtatcaccggctacaaaggaagtactcggatatgcatgctcatgcagcaaagaacaggctgatgaggcaatcaaggcatcttacgaagcattcaaaaaatggagcctgacatctgtagaagaaagagtacgtgtattaagaagacttgcagcacttctgatcgagaaccgtttcatcatggatgcatggaatgtccttgaaagtggaaagaactggggagaagctgacggagaactttgcgaacagcttgactttatcaattcttatgtaatgcatatccagaatctggaaaaaggaaaagagctggttcctacagatgaacttacaaaatgcgtttacatcccgctcggtgtaggtgtggctgtttctccatggaactttccactctcactgtttggtggaatgatcgtatctgcagttgttaccggtaacacgatctgctgcaaaccatcttcagacgctccgatcgttgcatacaaattcgtagaactctgccagaaagccggtattccggctgacgtagtaagttacattcctggatcaggatcagagattggtgacttcatcgtagaacatccgcttacaagatttgtaaacttcacaggatcaaaagcagttggatgcagaatcaatgaacatgcagccaagatcgctgacggacagagatggatcaaacgtgttgtggctgagatgggtggaaagaatgcaattatcgtagattcaacagcagacatcaagaaagcagcaaatggagttgcaagctctgcatttacattccagggacagaaatgctctgcatgctcaagagcaattgttctggcagatgtatatgatgagtttgtagatgaagttgtaaaatgcgcagcagaactgaaggcgaaccagggatcgggcgaaagcaatgcagcgatgggaccggttatcaaccagggcgcttataacagcattaccaattacatcgagatcggacgtaaagaaggaaatgttgtattcggtggtacatacagtgacgcagaaggatattatattgatcctactgtaatccgcgatatcaagagagatgcaagaattgccaatgaagaaatctttggaccagtccttgctgttatcaaagtagattcttttgatgaagcacttgatgtagcaaaccagacagaatatggtctgacaggatctgtatacagtgagacacgtgaaaatatccagagagcaaaagtagaattccaggtaggtaacttatactttaacagaaaatctacagcagcagttgtacttcagcatccatttggtggatttaacatgtccggaacagatgcgaagactggtacagcagattatctgacaaacttcatgaaccttaaatcaatcacagaagatctgaattcataggaagagccggacttaaaaaggacagggaatcagagtgtgtataaaagcgaagtattggcttggcagattatagaaaaaccggaggcttgtgtaaaaagacacatgagcctccggtttttattatcagaaattctatttttgatgcaaagtgtccaacaagtgatacggatgatttgcttagctgtctgaaaaagctgaccgcaatttactcatctttaaatccttcacccactacatcattcgattccatgattacaaggaaggactttggatcaatcgttttgatcagcttgcggattccgtacatctgcttattgttgcaggcgcacattatgatgtgcttatcatctttggaataacttcccataccatttaaaattgtagagccgcgtccgagaacctcatcgattttaaagcagatttcagtgctgtgctcgggatcggttacgatcagggcaagctttccttcatcaattccgtacataactttatccataacaagagagagcagatagctgacgatcagaccgtagatcagactgtccacgtcacgggatacaattacggttccgaggatcacaattactgcatccagtgcaaatgcaatatttccaagggaaaggtgagggttcagtgctttgatcgacatcatgataaagtcagagccgccggttgaagaatcacgcatatagatcattgcataaccaagtccggaaaggacaccgcagcagatggcagaaagaagtctgtcaccctgataaaccgggaacagcggtgcgatcacgtccatgattatggaagtaataatgatcgtccggactgaattcaggaaaaatctgcgtcccagaagccgaaaacaacagatggcgatcgggatgttaaggatcaaggcaacagtaccgatcggcagtccaaacaactggtaaaagatcagggcgattccgtttacccctaccatcggaaattttgcggcggcagcaaaattatagacaccgacagcgatcaggattcctccgataatgtcagttgcgatatcttttgtaagttccaaagctttgttctgattcatgataataacctccttgatgttgatggaatgtgatttataaaaagcaaaggcttgccagaaagaccaaaaaaaacacctgctaattatatctggatataatcgcaaatgctcttcatttctttagtatacgcgccataggataaggatgtcaacggttgtttaggttgtattcgtaaaataaatttgttatgataatgaacagaaaaagttgcaaattacagtgataaagtgaggaacagattatgaaaatagtttttttggatgtaaaaacaattggagaagatattgatctttctggatttgacaggttaggtgaagtcgtaaaatacgatttttctacatcagaagaagtaccggaaagagttcaggatgcagatgtgattattttaaataaagtacaggtcaatgaacagacgattggaaaagcagagaatttaaagctggtatgtgtgacggcaacggggaccaacaatttggataaagaatatctggaaaaaagaggagttgcatggagaaatgtagctggctattcgacagaaacggtggcacagcacacttttgcaatgcttctctatctgctggaaaagatacgttattacgatgattatgtaaaagaagagcgttacatcaatgatacaatatttacgcattttgcagagcattttacggagatcagtggaaaaacgtgggggatcataggtctgggaacaattggacggagagttgcggatatcgcaaaagcatttggagcacagattatttattactctgcatcagggcgttcggcgcaggaaggttacgaacaggtagatctggatacattgcttgcaaaatctgacattatatccattcatgcaccgttaaatgaacatacagagggcttaatggataaagcagcatttgcaaaaatgaaaaaaacctgtattttcctgaatctcggacgtggtccgatcgtaatcgagcaggatctgtatgaggcactggaaaatgacgagatagctgcagccggacttgacgtactttgtcaggagccgatgagtgagacgaatccgctgcgaaaaataaaagacagcaaaaaactgctgattacaccacatgtagcatgggcgagtgtagaagcaaggacaaagctgatggggataatactgggacagataaaagaatattttcaaatttaagaaaccggagttgtcgcatagattttagtgatatgcgtcaactccggttttgcttaaaatatttgtttacttgttaaatcggattaaagacgaaatacaaccctttacatctccgcgtataatttcacaagctcaactgcgatatccacagccttgtccattccctctgccgtgatgtgttcatatggtccatggaatgcatgtccccctgttccaaggttcgggcaaggaagtcccataaagctgagctggcatccgtctgtgccgccacggatcggaagcacaagcggtgcaacacccgcattttcacaggctttctttgcattctcaatcagatgcatgcatccggcaataatctcagccatattctggtactggtcagtaatcataagcttcacagtgccttctccccatttttcattgagatttttttcgatatggcgaagagtttcttttctggcttcaaacagattcttgtcatgatctcttacaatataatgaagctctgcttttgccacatctccactcataccggtcagatggtagaatccttcataatcctccgtttcacgcgggatttcaagtcctgggagcatgttattgatttcagcagcaaccaggcacgcattgatcatcgtatccttgctggaacccggatgcacagcaaagccggtaatttcaaaatctgccttgcatgcattgaagttttcatactgaatttctccttcggtatcgccatccagagtgtaggcaaactgtgcaccaaatttttccacattaaaatgatcagttccaccaccgacttcttcatctggtgtaaaagcgattgagaccggtccatgaggaatattttctttgatcagtgcttcggccatggtcatgatctcggcaactccggctttatcatcggcaccaagaacagttgtaccgtctgttgtgatcagggtgcgtccggcaagagatggaagatgcgggaaaacttttacggtaagggtacgtccacttgtgccaagcggcagatcaccgccatcgtagttcttgtgtacgaccgggatgatgtcatggtcacagtaatcggaaacggtatccatgtgtgcgataaatccgatagatggtttattctcatatcccggtgtggcaggaatctttccatatacatagcagaattcatccagacttacgtcagaaatcccgagggcagtcatctcatctgccagaatacgtgccaggtcgaactgacactgggaagaaggagaagtcgtactgtgttcatcacttggagtacggactactacataatttaaaagtcgttcatatgctctcataatcaaacctcttttcattaacatttcttatccgagtatagcattttgcaggtgaatatgcaattgtggcagcaggttctcttttgggtgtggcattgcataaaggaacttcttttccggtcggaaaggtagagtttatggatctttatccattgacatttcaggaatttttgtgcgcattaggagaggaacgcttcgtaaatattcttcagggaacggataccgatatggtgacaacattcaaatctaaatatatagaccgattacgcgaatattattatgtaggtggcatgccggaagtagtacagacgtatgtagaaacgaaggattttaatcaggtcagagagatacagaagaacctgttgaattattatcaacaggatttttcaaaacacgccgagacttcattggttccaagactgaatcttgtatggaattcgattccgatgcagctggcgaagaaaaataaaaaatatatctatggacaggtgagaaaaggatcaagggcaaaagattttgagctggcaatacaatggcttttagactgtggactgattcataaggtacaaagagcagggaagaacttcgattattccgttggaagtgaaagcggaggaaaatttgagggcaaaaagcctgaaagcgttctgtgaaaaatataagcctaaatatgccgtaagaacgtcaatgtcagattaccgggaacaggaatggatgacaaatattcctttgtataatatcgacaggatcaaagaatatctggaacaataaaaagctgaaaatatgaaaaattatggaaatctataaggactgaaaaataaaaaattgcacaaaacaaagaaaaaagtttgaaaaacagcaaaaatattgatcaaaaaagatgcgattttggttaatcttgataatccatgagtgctataatacagctgtaacaaggaaataggtactttaccagaagtcagtgattggaggaaaagataaatgaatactttaaaagctgaaaaaagaaacatgcagacaaaagccaaaaaactcagaagagaaggttatgtaaccggcaatgtattcggacgtgagattgaaggctccattccggtacagatgacacagaaagaagcggaaaagttcctgaaagctaatggcaaaggaagccagatcatgttggatttggacggagagcagatggatgtgctggtaaaagaagtcgattatgattctatgggttcaaaagtacttgaaatagattttcaggcactggtaagtggagaaatggtacattctgtagcagaagttgtgatccacaatcagtcaaaggttgtcacaggtgttgtggaggaactgcttgatgaaattgaatacaaagcacttccatctgcacttgttgaaaaagtaattgttgatgttggagatttgaaggttggagaaaccattaaagtcaaagaccttgacatcgcaaaggataaagatgtcaaactgatcacagatccggaagcagatgtagcaggtgtggctgccgttcataatgatgttccggaaacagatgaggaagaagcagcagttgaataaaaagattttgtaaaaaaggcggacgctttgcagaaagaactgcaaagtgcccgttttttgcttcatagaaaatcccgaaggaacttcctatgaaacaaaaggcactgcgtgccggagatgcacattctttctatttaatgaaattcctaatcccatttttcagcaggaaatcataacggaatatttacataaaatcaggaatctttatacaatctttatactaaaaatactatcattgatttacaaaacaggagaggaaaaacagtgagaggaaggaaaggttatgttcgagattgagagtattattttatttacagggatcctgagctttctgctgatcgccggattgcatctgatgcgtgaactcgacatttttctgaagaaggataaaaaagagagagaggaagaaagatatagaggagaaaggaaacgaaacaaatgacagtaatatataaaaagatgacacagacacagatgattgttgtcgggtatttgttgttgatccttttgggaagtattctcttaatgcttccggtttcatcaagggatggaaatatgacatcttttgcagatgcattatttacctcgacatccgcatcctgtgtgactgggctggttgtacaggatacatatctgcactggtctttttttggacagcttatcattttgatcctgatccagatcggcggtatgggatttatgacaattggtgtctgtgtggcgattctgttaagaagaaagatagggcttaaagtccgtggaattttgcaggagagtatcaatagtattcaaattggtggaattgtaaagcttacgaagaagattataaaaggaacacttttttttgaaagcattggagctgtattgctgatgatccggtttattccggaattcggaataggaagaggaatctggtacgggatctttcattctatatcagccttttgcaacgccgggtttgaccttatgggagaaaatggtgcctatcagtcactgatcagatattcggatgactggctggtaaatacagtgatcatgctgctgattataatcggtggaatcggttttttggtgtgggatgatctgtctgtgaaaaaatttcaatggaaaaaatatcatctgcatacaaagattgtattatcaacaacaggttttctgattataggaggagcagttttattcctgatactggaaaaaaataatgtactggcagggatgcctgtgaaagaacagatactctgttctttatttcactcggtgacagccagaacggcaggatttaatacaaccgatacaggagcgttgacggaaggcagtaaacttgttactatgattctgatgttcataggaggaagcccgggatctacagcaggtggaattaagacgacaaccgtagtggttcttattgtatttgtgcgtgcaaatctgatggaagcagccggttgtaatgtatttaacagaagactggatgaaactgcgatcagaaaggccagtgttgtaatgtgtacgaatttgttccttatactaacaggaacgatcttcatggaaattatgcagccgttttctttggcggatgtgatgtttgaagtcttttctgcaatgggaacagtgggaatgtctgcgggaatcacaagagatgtatgcatggcatcaagaatgatgctggtatttctgatgttttgcggaagaataggaagtctgacatttgcgctttcattgaaagggcacagacatgaagcaccgatccggaaaccggtagaagaaattacgataggatagaataaggagtagaaaaatgaaatcagtattgattattggacttggaagatttggccatcatctgtgtatggatatggcaaatcggggaaatgaggtaatggtcatcgataaagatgaaaaaaagacaccggatttgttggaatacgcaacagcagtacgggtaggggactgtacaaatgaagaagtattaagaagtcttggagtaggaaatttcgatctttgctttgtgtgcatcggatcaaatttccagagcagtctggagataacaagcctggtaaaagagcttggagccaaacatgttgtcagtaaggcaaacagggatatccatgcaaaattcttattgagaaatggagcggatgaagttttttatccggatcgggatattgcagagcgactggctgtaaaatacagtgcaaatcatgtttttgactattttgaactcagtaaggattattcgatttttgaaatccagccgaaggctgcatggatcgggcggacgatagaagaagcggatataagggcaaactatcatataactgtatttggaataaagaaaaatacagagctggtggtccttccgagagcggattatgtgatgcatgagaaggatcatctgcttgtagtaggtcttacaaaggatattgaccgtctgcttgcaagtataaaatgatgaatgatgggggaaagaaaatgacaaaaaagagagtaaaatatatggtgcagtcgattgcgatcatggcggttgcaacatttttgtctttttttctccagagttatggaattcgaaaagaaaatattctgatgatctatattgtgggtgtactggtcataacagttacaactaccggttatctgtatggaatgatggcttctgtatgcagtgtgttgctgtttaattatttttttacagtgccggtgcatacatttgcgatgacggatcagaatgatgtggtacgtctggtatttttccttatcacaggattcatttctgcaagtattatggtacgatttcataatcaggtgcgtattgcagaggaaacaagggcacagatggaaagagaaaagctgaaaagcaatatgctgagaagtatatcccatgatttcaggacacctttgaccggaattatgggagctgcaggactcttaaaagaggcggatgagttggatgccggagtcagaaaggaactggcaggagagatacaggagcagtctgtatggctgatgcgcctgatggaaaatattttgaatatgacaaagctggaaagtgaagaatttgagatccggaaaaaccaggaagtagtggatgatctgatctatgaagccgtatcacatatcataggactccgggaaaagaggaggtttgaaattaaacttccgtcggagctgattgttgtaaatgtagatggaaaactgatggtccaggtgctggtcaatcttctggataatgcgatgaagcatacaggggaaaatggatggatctgtatagaagccagatatgatgcagggaaagtgtggatcagtgtagaagatgacggagacgggattcaggaagatctgaaagaaaatatttttgacgaatttgttacaaggtcagacgaaaaaggggacagacaaagaggaatcggactgggattggctatatgtaaagcggtagtaaatgcacatggtggaaatatttgtgcagagaacagaaaagaaggcggagcaaggttcatgttctggttggaggcaaggcaggtaagtacagatggcagataagcataaaattttaattgtggaagacgataaatatattattaactttatctcgatgagtcttaagaaagaagactatgattatgtgattgcgaagacatgtggagaagcaaatgcactgttctatgcaaacagaccagatatgatcattctggatcttggacttccggatggtgacgggattgagattataaaaaatgtaagagaaatctcgaagataccgatcattgtggtcagtgcaagacaggaagaggaagaaaaaatacaggcactggatctgggggcagatgattatgtgacaaaaccgttttatatgggcgaactgcttgccagaatccgtgtggcgctcagaaagagtaaccagatcccggaagagaagaaagaaaaaatctttcagtgtgattatctgaaagtggactgggaaaaacatcaggtatcgatagatgggaaagaagttcatctgactccgatggaatataaaattttgaaactattgatcgacaacaggggaaaggtactgacacataattatattctcagccagatctggggcagtgcacagggagtagaagcagccaacctgagggtatttatggcagcactgcgaaggaagatagaaaaggatcccggaaattgcagatttattctgacagaaatcggagtagggtaccggtttagagaggctacggagtaaaacaatttgcagacgatgaaattagttagaaaaaacgaatgttattcttgaatgactacctacaggactgatatgataatgatataaattatcaataaatggttttgccaaaggagacagatagaggaatgacattaaaagaattacaagtcggaaagacagctacgattctttccgtaggaggaaatggtgcactcaggcagcattttctggatatgggattgatccagggaacagaagtaacgattgtaaagtatgcgccgatgggggatccggttgagatcaggatccatggttatgaacttacgatccgtctggaggatgccggacagattgaaattacgccggcccatgagccacattataagaagaaggaaggcagacaaccgttaggagatgcacagcatccggggtatggagaagcaggcatttttcatgagaagaaaacagagcatccgttaccggagaatacgacacttacgtttgcattggttggaaatcagaattgtggaaaaacaacgctgttcaaccagctgaccggatcgaatcagcatgtgggaaatttcccaggtgttacggttgacagaaaagacggtgtgatcaaggagcatcccaatacccgtattaccgatcttccgggaatttattctatgtctccgtatagcagtgaggaaattgttacaagagaatttctgcttcaggataaaccgaaaggaatcatcaatattgtagatgcaaccaatattgaacggaatatgtatctgacgatgcagcttatggaacttgagatcccaatggttgttgcgctgaatatgatggatgagatgcgtgtgaacggaggttctgtgcgtgtgaatgagctggaagcatttctcggagtaccggttgtaccaatctcggcagcaaagggagaaggaattgcggaactggtagaacatgcactgcatgtcgcaaaatatcaggaagcaccggaggaagtggatttctgctctgctgaaggtcaggaaagtgcggttcacagatgcattcatgcgatcatgcatctgattgaagatcatgcaaaggaagcagggatcccggtcagatttgcagcaagcaaactggcagagaatgatgagcttgtcctggaaaaattaaagctgagccagaatgaaaaggaacttctggaacatatcaatctgcagatggaagaagaatgcaaggtagaccgttcatcggcagtagcgggaatgcgttttaactatatccagcgtgcctgtgaagatacggtcttaaagccacatgagagcagggagcgggtgcgaagcaggaagattgatcaggttctgacaggaaaatataccgggattccggcatttatcgcaattatgggactggtattctggctcacatttaatgtgatcggagcatttttgcaggatcttctgcaacagggaattgaccaggtgattgtagcctgcagtcaggcactggatgcggcaggagtcaatggcgtattaaagtcactgatcgtagatggaatctttcagggggttggaagcgtgctgagtttcctgccgattattgttacactgttctttttcctttcgatgctggaggacagtggatatatggcaagggttgcgtttattatggataaacttttgcgaaagattggtctttccggaagaagtattgtaccgatgctgatcggatttggatgtacagtaccgggagttatggcgagccggacactttcttcagagcgtgatcgtaaaatgacgattatgctgactccgtttatgagttgttcagcaaaacttccgatctatgcattctttacagcggcgtttttcccggggaagggtgcaattgtaatgattggtctctatttctttggaatcctgatgggaatccttactgcacttgcaatgaaagggacgatgttcaaaggagaacctgttccgtttgttatggagcttccgaattatcgtatgccgggagcaaaaaatgttggtcagcttctctgggaaaaagcaaaggacttcctgcagagagcatttaccgttatttttggtgcaacgatcgtgatctggttcctgcagagctttgatctgcatctgaatatggtgacagattcacaggcaagtatccttgcaacggtagcaggtatgatcgcacctgtattcattccacttggattcggtgattggagaatatcaacggcactgatttccggatttatggcaaaagagagtgttgtctccactctttcgattttgtttgggtcaacagcagcactgacagcggtgataaatacagccggtgcagcagcacttttaattttctgtcttttgtatacaccgtgtgtggcagcgattgcttctattaaaagagaacttggtggtaaatgggcgatcggtgttgtgatctttcagtgcgtgattgcatgggttgctgcatttattgtgcatggaattgtatgtttgttttaaaacaaaaacttctggaaacaggaaaactgcttccagaagttttttattgcagatattttttcaaggcatccagataagttgtccctaatctgcttaacatcctttttttatgtgtaatatacccaatccgcatatcactttcgtcagcaagaggaacggcaatgatatcttttccattcaactttttgtcaattacaccactgcatactgtgtagccatttagcccgatcagaagattaaataaggtggcacgatcccgtacacggatatttttcttgcgttcagatacagaaaagatttcttctgaaaaataaaaggaattgtgttcaccctgttcaaaggaaagatatggataatcgtccagttcttcattggtgattattttgtgattggcgagagggtgacgtctgctgataaatacatgtggttttgcaacaaacagttgatgaaaaataagcccgttggattttaaaattttttccagaaccgtttcattaaaattatttaagaaaagaattccaatctcgctgcgcatttttgctacatcttcgatgatttcgtatgtctgggtttcgcggagactgaaatcatattcatcctgtccgtaggttttgatcagatcgacaaaggcattgacagcgaaagaatagtgttgcgtggatacacagaatttctttttcccgccggaagttcctttgtatttatcttcgagaatagcggcctgttccagcacctgtctggcgtatcctaagaaatcttcgccttcttttgaaaggatgatccctttattagtccggagaaaaatggtaatcttcatttctttttccagttcacggattgcgtttgtcaggcttggctgggaaatataaagacgatttgcggcttcggtaattgttcctgtttcagcaacagttacgacgtattttaattgttgaagagtcatatttttcactttctataaagaatattgtttttgggtttgggatatcagaaaagtatctggaaaatgtatcttagcggaaaatacttctggccagatatcctggtaatattgtagcatggaagcagggagcgtgtaacatttttttgatattgctatagttttaaactatggcaaactgcattttttttgtatttttcagatgcagaatactctgctatactttcaaacataaaagacagacagtacgaaagagaaaaggagagctatattatgagtaaaaatacaccatttcgttatgattatgtaggaagttttttaagaccggaaacactgaaaagagcaagaagagattttgaagaaggaaagatttcaaaagaagaactgacaaaagtagaggatgctgcaattttagacctggtagagaagcagaaaaaagccggatatcatgtgatcacagacggcgagttcagaagagcaacctggcatcttgatttcatgtggggatttaacggggtaggacatgagccgactaagaccggacttccgttccacggtgaagctgcaatgatcgatgatacttatttgactggaaaaatttccgtagatcagcatccatttgtagaacattttaaatttgtaaaggcactggaagatgaaaatacagtagcaaagcagacgattccggcaccggcacagttcctggaacagtttattatgccaatgtcccttccgaataccaatcagtattatccggacgtggaagaactggcagaagatatcgcaaatggatataagaaagttattcgtgacctgtatgatgcgggctgtagaaacattcagttggatgactgttcatggggaatgtgtgtagatccacatgctgcagcaattttcggaaccgatgaagccggacttcagaaaatcatggaacagcttcttgctatcaataaccgtgcaattgagggagcgccggaagatctggtgatcaacactcatgtatgccgtggaaatttccattctacttatgcaagcagtggtgcatatgaccgtgtggcagaagctttattcgcccgtgaaaatgtaagtgcatattatctggaatttgatgatgcacgttctggtggatttgagccgttgaagagtgtaagtggtgataaaaaagtggttctcggtctgatcacaaccaagtcaccaaagctggaagataaagaagacgtaattaagagaatccatgaagcagcgaaatatgtcccgctcgacagactgtatttgagtccacagtgtggatttgcttcctgtgaaatcggaaataaactgacagaagaagaacagtggaagaagcttgcactggtaaaagaaatcgcggaagaagtatggggcgaagaaaaataagccagatataaaaatttaataaataagatacatacagctcctttcaaatcgtgctacaatagaagcagatttgaaaggagctgaaaatttatgaatgaagtaatcaaaaatatggaagaacgcagaagtgtccgtggatacaaaccggatatgatcagaaaagaggatctggatacgatcattgaggccggaacttatgcggcaacgggaatgggaatgcagtcaccgatcatcgtggcagtgacggataaagcaacaagagatcagctttcagcaatgaatgcaaaaattatgggaaccgatacagatccgttttatggtgcaccggtagttcttattgtacttgcagataaggcaagaccgacatatctttatgatggaagtcttgtgatgggaaatctgatgaatgcagcgcattcgcttggaatcggaagctgctggatccaccgggcaaaagaagaatttgaatccgaggaaggaaaggctcttctgaaaaaatggggaatcgaaggagactatgaaggaatcggtcattgcgtacttggatatgcggcagcagaacttcctgcagcaaaaccaagaaaagaaaattatgtctattatgtagaagcataggagtgtgacatatggattacgaaggacagatttgccgggccccgatggaaagaagctctttcatgcttccggttatggttggatgctcatataatcagtgtaaattctgtaatttattccggcatctgaagtatcgggaacttccgatggaacagattgaagcggaactaaagagagtgcgggaactgcatgggaagccgaagaagatctttctgggggatggtaatgcatttggtctgaagacagaaaaattgtatgagattctggatctgatcgcatattacttcccggaatgtgaagggattaatatggatgcgactgttacgagtattttacataaaagccaggaagagctggaaatgcttgctagaaaaaaggtaaagcatctgtatcttggaatcgagagcggactggatgatgtgctgaaatttatgaaaaaagatcatgatctggcacaggcatatcaggcaatcgacaggcttcatggagcaggactgatctatgatgcacatattatgaccggagtcgcaggaaaaggaagaggaatggaaaatgcagaagcactggcgcagttcctgaacaggaccaatccggcgcatgtagtgaatttttccatgtttctgcataaagaagttccgttgtatcaagatatacggcaaggtacttttgttccggcagatgagctggaaacaattcgggaagaatatcatctgatcgagaggatcgcaccggaaaaagcaggagcaaatattttatatgatggttttcatgactttatccatgtgagagtcagaggacatcttccgggtgataaagaaaaaatgcttgccaaattaaatggtatcattcaggaatatgaaggaaaagaaccggtttattcctttgtacagggggaatgcccggatctggaatactgtgatgatggtaaagcagtatgggatatggaccggaagacttcatagaatccgctatactatgaatcagcagaaattgagcgcgtcagcaggcgcgctcttgaactttggaacagaaaatatgtcataaaaaatccactgtatctgatctttcagctacagtggattttaatttgatccatccattggattatcctccttattcacttcttatctatctgaaactattatctcaaatagttttttctatgtaaatttcaataattattatgccattggtctgcacctcttgatttcattgatttgatattgtataaattatcttgccattggtctgtacctcttgctttcatcagatttattctggttttaaattatgttccttttggtccatacctcttactttcattagattttgttctggttttaaattatgttccttttggtccgtacctcttactttcattagattttgttctggttttaaattatgttccttttggtccgtacctcttactttcattagatttgtccgagttttaaattaagtgtcctttggtccatacctcttactttcttagactttggagttaagattaagtttctggtggtccgtcctccttttgttttgttgatattataatatctcataaaatgcaaaatgtcaataaaaattctgaaaaaaataaaataattttaaatatatgaaataaatcaggaatacatataaaaatgggaaaatatatacgataaacaaataaatatacagaaaaaaacagaaggcgcagtccgaatttcgactacaggaaatgaaatgacgatgtggatatgcggaatccgcagatcatcgagacggtatggggagtcggatcccggtttaaccggttgtaaaaacgattggtgttatataatatctttatggataaaatcccaattgtaagttcatggttggcatgataagatgataccatgaatttacaaaggagaagactatgaatcactatactggatatgaattactgtggctcttttttatttattcttttggtggctgggtattggaaacgatatcggcaactttgaagcagagaaagtttgctaaccgaggtctggtaaatggaccgttctgtgtgctctatggtctgaccgcaattgcgatgacagtgggattacaggaacttcggggaatctggctatttatctttgcaacggtctatgcaacagttgcagaatgggtcagtggacatctgatcgaaaaagcattcaaggcaagatggtgggattattcaaatatcaaatggaacctggatggatatatttgtcttccggcttcactattttggggtgtgctcggttatctggcagtgagatggtgcaatggggtcacgttgattttattacatattctgccgaagcttctgatgcatattgtgctgctgacactgatcggtgtactttttgtggatatctttggttcctttatgcttcttaccggaaagagtaagaagccggagcgctggattgcaacggatgccgggatggataagatcagcacaaaaattgcgggaaagattgccggaagtctggaaaagcgtctgaaaaaagcatatccaaaggcaagaaaaatcgaagaggaaatccgggaagagaacgaagaaaaggtatttgcaaaagggtgcggcttttataagatcgtgatgctgtttatgatcggtgcttttctgggagatatcacagaaacgattttctgtcgtgtgacggctggagtatggatgagcagaagcagtgtggtctggggaccgttcagcattgtctgggggcttgcaattgcgcttgtcacagcacttttgtacaaatataaggataaaggggatcgttttcttttccttacaggaacattgcttggtggtgcttatgagtatttctgcagtgtgtttacggaacttgtatttggaaaagtgttctgggattacagtaagatcccgtttaacctgggaggtcgaatcaatctgctttactgctttttctggggaattgctgcggttgtgtggtttaaaatattatttccacctatggaaaaatggatagaaaaaataccggcagttgcaggaaagcttttgacctggtttttattagtatttatggtctgcaatattctggtatcctgtgtggcactggtaagatacgatgaaagaggaaatggtgtacaggcgacgaatgttgtccagaagtgggtggatgtgcattatgatgatgcgaagatgaagaaaatctatccaaatgcgaaggggataaattagaaaaaaagcgggaacatattgacaaaattctatatgaagagtaagatgtagttagaaaaccggtgtgagaaatagattgcaccggttaaaaaatgaaaaatatatagaaatatttctatatttctatgggaagggagagagcatgaaaatcataaaaaacggatgggatttctttcaggaccagattcttggaatgcactggctgaaagatctgatcggaaaacttcttgttaaagccggattgggagagggaaggtttccaggagaatttcttcactttttcctgtatgatatcataaaaatttttgtgctgcttgcggtgctgatctttgtgatatcctatattcaaagctattttccgccagagaaaagcagaaagattatgggaagatttcatggaatctgggcgaatctgatcggagcacttctaggaacagtgactccgttctgctcctgctcatcgattccgatctttatgggattcaccagtgcgggattgccgctgggagttactttctcgtttctgatttcatctccgatggtggatttgggatctctggttcttctgatgagtgtctttggagggaagatcgcatttgcttatgtgattgttggacttgtcatagctgttatagggggaacgatcattgagcggctgcatatggaagaccaggtggcagattttatccggcaggcgccgaatgtggaggtagcttcgccgtcgcttacaatagcagaccgtatggattatgcaaaaaatcaggttgtggctaccgtcaaaaaggtagctccgtatatcgttgtcggagtcatcatcggggcagctatccacaatctgatcccagagcatatcgtccgaagcattcttggaaaacagacctggtacgccgtgccactggcgacagcagtaggcgttcccatgtatgcggatattttcggaaccatcccggttgcagaaagcctgctggcaaaaggtgcaggacttggaacgattctttcgtttatgatggcagtgacaaccctttcacttccatctatggtaatgctgtcaaaagcgatcaagaaaaaattgctcggaacattcatcgggattgtctgtatcggaataattattgtggggtatgggtttaatatgataatataggggagcaaactcatatgacgttcgtgcttgcacgaaaaggcatatgaatttgctccccgccggccatgaggaagaagcgatttacgaaggaaatcagcggattccgaatggacgtaggattgcgggagcagcaacgctgcggagcaatccgtaatattatcaaaagtagtggggaaaatccaaatatcattcgtgcttgcacgaaaaggaaaagatttacattacccgaggtgacagaaaaatgcagatagattatgaaaaatatgcccgtatattcaaagtgatgtcggatccgaaacgtctgaagatcatcgacatgttatctggaggagaattatgcgcctgcaagatcctggaggaatttcacatcacacagccgaccttatcgcatgatatgaagctgatgtgtgatctgggaatcgtaaaggcgcgcaaagaaggaaaatggatgcagtattctctggatctggatgtgatgaatgaggtttacaagacggttgggcggctgatgatcccgggagattatgcagggcttttaaattgcaattgtaatacagaaaaggaagaaaaataagttgcagcggcagcagagcaaatcagggtgcagttgcagtatagaaaaaggagaaatgaatcatgagtaagattaaattgtattttttgacgggatttctgggatccggcaagacgacgatcctccggaatttgctggaaaatatggaaggaacaaaggttggagtgatccagaatgaactgggaaagatcagtattgatggaaccgtgcttcagaataatgatatccagatggtagaactgaaccggggatcaattttctgcagctgtctgagattatcctttgtggatgcgctggttcagatgtccagaaaaggtttggaatacgtgtttgtagagagctcagggtttggagatccgtccaatgcggaagaaattcttgcggcgacggaagtgatggctccggatgcatatgatttcaaaggctgtatctgtctggtggactgctataattttctggatcaggtcggagattcagagacgatcgaccggcagcttaaacactgcaatcttgcagttctgacgaaaattgatctggtagatgagaaccagattgagaaggtgaaagagaaagtgcgtgagattaatccggtctgtccgatcacggagagtgccaatggaaatattgaccgttcgttttatgatatggatctgatgttgtacaaatgggcggaatgtgaagatactacgaattcatcgaaaaataaaccgaaaacattttccatggattttacaggagagatccagaaggaaaagttggaagctttccttgcaaagattgaaccggatgttttccgtgtaaagggattctttaaagtagaaaaagaaggatgggaaaaagttgacgtagtcggaaagaaacgggattatgcgccttacaaagcccagccgaagtctcagcttgtttttatttccaaaatcggaatcgcactgatccgcgaaatcgcggcagcgtgggaagaatgtgtgggacttcctatgaaactgaataattaaatctggaggtaggatatgaatataaaagtaatcggaagcggctgtgagaactgtgataagacgaatgcggttgtgaaggagtgtcttgaagagctcgggatggatacggaaatcgagagagtgacagacctggttgagatcgtaaagctgggagtgatgacggctccttcggtgatgattgacgggaaactagttgttgcaggtcaggtgccatcaaaaaaacagatgatgaagatattgaaaaaatgaggtaaaaacaatggcaaacaaatttcatgattttgatgaaccgatcaatcgtattggcacagattctttcaaatgggattatgaaggagaaaatggaaagtatattccgcttggagtagcagatacagacttcaaagcaccggaagaagcaattgcagcagttcgtaaacgtacagaatttggtgtgtatgcatatggtgcactgccacaggaaagatttgcagcatcaatctgtaactggtataaaaagagatatggtcttactgttgacccggaaacaatccgtcattcacagggactaatgacaggtgctttatggatgatcctgaatgcatatacccgtccgggcgataaagtgctgatccaggctccggtttaccatacattcagcatcgtaatcaaaggtgcaggacgttttgttgaaagcaatgatctggtactcgaagatggccgttatgagatgaattttgaagatcttgagaagaaagtagcagatccaagagtaagaatcatgctgatctgtaacccacacaatccggtaggacgtgtatggacaaaagaagaacttatcaaagttgcagaaatctgtaagaaaaacaatacaattcttgttggtgatgagattcacggagatattgtatacggagaacacaaacatactccattattctcactttcagatgaccttacagacaatatcgttgtaatgggatcaccaagtaagacattcaatcttgcatgcttctattctgcatatgttgtaatcaagaataaagcgcttcgcgaccagtacaatgtggtatatgatgatttccactttgactataactatcttggaatcgaagcacttatggcatgctacaacgagtgcgattactatgtagaccagcagaatgaatatttctggaagaatatcggtgtagtaagagatttccttgcggagaatatgccggaagttaagatgattgaaccagaaggaacttacctgctgtggattgatttcagtgcatggaatatggaacaggatgatctgatgaatgcatttgcagaagcaggtgttcgtttgaacagtggaacaaactatggtgaatgcggaaaaggatatgttcgtctgaatgtggcaacacagaccgcagtattaaagaaaggtctggagtgcattaaagtagcacgtgacagccatatggcataacagaaagaaggagcaaaagatatggcaacaagaccaagaacggagaataatccttttgcatatggaatgcgccttttagctgttttttataatgaaatggaaaagaataaagacaaaatttcatttataaaaagttatcaggaaatagaaaagattttttataagaatgtcctccggctctataaagatattttgtaaatagttgatcataaatacagggcgcatccggaaaccgccgggtattgtgccgagttttttgaatccaattcgttcataaagatgtaatgctggggtgttggtagcaacaaccgcattaaattgcagaatgcggaactggttttcttttgctttctgcagacaatcaagaaccagtttttcacctatatgcaatccacggatatttttacggacagcatagctggcattacagatgtgcccacatcttccaacattattaggatgaaggatataaaggccaagaatttcgtgagtgtccgcattttctgcaataccggtataagtctgttcctgaaaaaataagttggcaacgttagctgtcatttcggtatcctgtggaaatgcatttccgtctgttacaacctcattccatatctgtgctgcagaggcagcatctttactctgataagctctgatttgaatattcatattataaaacctcctttctatttcctgttgaaattattttaaaatacacctacaataaagtaaaactatgaattattcaaaataagaatagtattacttaaaataaatatttaaattaagaggtgaacagatgtggaaagtgccagatgtaaagcttttatgtatgctgcagatactgggagctttacaaaagcagcagagagattaaattatacaccgtcaggagtcagtcagcttgttggagctttggagaacgaaacaggtcttaccttactcagacgaacgaggaaaggggttaccctaacaccggatggggaaattcttttgcctgcagtcagagaatttcttgaaaaagaaaatcgaatctatgagctcgcagcagaagtaaagggacttcttgtaggcagtgtgacgattgcagcatattccagtatttctacgcactggcttccggaggtgatccgggactttgaacaggattatccgcagatcgaaatccggcttatggagggaatccggcaggaagtgacaagatggctggatgaaaaaaaggcggatatcggatttttaagttatcaggagccaatgccgtatgagtggacaccactggactatgatgaaatgctggcagttttgccaaaagatcatccgtatgcatcaaaagaaagttatccgttaatcaattgtgagaccgattcgtttattatgccggcacttggacgggatgatgatgtggtttcgctgtttgagcgaaatggaatcaaactgaatattcattttacaactctggaaaattttgcgacaatggcaatgattgaaaagggacttggaatgagtgtgatgaacaatctgatcacggaaaagtggaattgtgatgtagtgaagattccggtagatccaccatcaaggatcacacttggacttgcagttccgtcgtataaacaggcatcaccagcggtaaaaagatttatcaaatatgcggttgagagactgaaaaagatagaatagaggagaacagaaaatggcagatttatttcatcgcgtaagtatcagaaaatatcaggacagaccagtggagagggaaaagattgtggaaatccttcgcgcggcaatggcagcaccgtctgcaaagaaccagcagccgtgggaattctatgtaattaccaaaaaagatacactggagaaattatcaaaggcaagtccgtatgcagggatgacggcgaatgcaccggtggcaatcatatctgcatatcggaaagattgtgatgtcccatgttatgcggacatcgatatgagtattgcaatggagaacttatggcttaagacagatgaaatcggacttggcggagtctggcttggaattgctccgatcgaagagcggatgaaggaagtggaagagatcgttgggattccggaagatcagagagcattcgcaatctttccacttggatatccggcggaagaaagagcgcagcaggaccggtttgatgagagcaggattcattttgatgcgtagaagttctgtgaaaatgtttaggtaaagcataagaaaacaggacagatatttgatatcatttttatcagaaaatgaggaaagtgatatcaaatatctgtcctgtttttgtgtatacgatgtgcaaaatgcagatttatgtttgcataaggatttgtatttggaaaaagtacatcacctggctgttaagcaagatggtacacaagctgagcaggagcagcctgctcgattattacgacacagccggcgtcagaaactctttaatataataaagtgccgcaccaatcgcaggagtatactgtccatgatttcccaccagaagctggctttcgtccatctggaaaagggaactttcattgatcttgcttaaaagatactgcatatctgcttcctgaaaatatggtgcaagatatccgctgatgatcaccggactgtcgatcacaagattcaggttacggattgcaaaggcaaggtggtcaagatagtctctccagatttgtgtgagattcagagcatgtgtctgatgcaggaggttaaaaaattctttgaccggcataccggaagctgctttcagggcatttgcagaacagtaagtttccagacacccgtgattgccgcaataacatttcggaccatttggatcaatgcagatgtgttcaatcagaccactacgcatatgatcgccctggtgaacttcatgtccggtgatgatcgcaccgccaaggttaggattcagaagaaaaatcagggcactgtcaaattgtggatgattccagagttccagatctgcagcggcttttgaatcgtgttccagatgacatggatacggaagtctggaagaaaaatcagacagctgcatgtttgcatttcccatgatatcgccgtaagtaacaacatttccgtccggggagatgacgccctgggtggcaatcgaaatcccttcaattttctcaggatcataatgattcttttggataaacagttctacatttgcagcaagggcagagtagtaagcatcgctgctctcgtatggcagctcaatcgtttcggttgcaattgcatctccatatagatttacggctacaatatgaaacatatcttttaaaatcccaagtccgatcgaaatacggaaatcttcaacaatttttataatctgggcctttcgtccgccggttgattcaaaatatccattccggctgatcagaccgtcattttccagctcatttaaattctggctgacagtagaaagtcccatctgcagatcctgaacgatctggagtttggatgtttctttttgctgataaatatattggtacactttttcccgattgatttttttcagggtaatcgtggtcattcctttttctttcatgatattctcctttacttatgcgtgaatcatacacacaagatatgaacttattctaatatagatgtgcggataaaacaagagctttctgattcgctttgtgaaaaatagataaaaatagaattgtaaaattgtattttttgtcaatagacaactcacttttgtggttatatactacacttacaacttagatataagcgtaagtcaaaaacataactaaaaagaaaaagtaaaacgggaggtaacaaaatgaagttaacaatcgaaggaatcaaagaccgtgcggcatgggagaaggcaggaattgcacttccgggatatgatgtggagaagatatctgaaaaagcaaaagaagaaccgggatgggttcattttggaatcggtaatattttccgtatttttatcggtggaattgcagacggacttctggaagaaggtgtactggacagaggaatcacctgtgtagagacatttgactatgacgtagtagataaaatttatgatccatatgacaatctgggactgagcgtaattctgcatggggacggaacacgtgaatataaagtactcggatcccttgcagaagcagtaaaagcacagtcttctgatttggcacagtggaaccgcctgaaagagatctttacaagcaaatctcttcagatggtatcctttacaattaccgaaaaaggatatgctctgcagaaagcggacggaacctggtttccattcgtggaagcggacattaagaacggaccggacaaagcgacaggagccatggcagtactggtagcaatgctttatgaaagattcaaagcaggaagatatccaattgcattggtatctatggataactgttccaagaatggtgcaaaactccgtgaatctgttcttacaatggcagaagagtggaagaagcagggatttgtagatgatgatttcattacatatgtaagtgatgaaaaagtcgttgccttcccatggaccatgatcgacaagatcactccacgtccgagcgaacagattgcagatgatcttgaagctctcggtgtggaaaaaatgcagccggtcatcaccggaaagaagacttacattgctccatttgtaaatgcagaaaaaccgcaatatttggtcattgaagacagttttccgaacggacgcccggcactggaaaaaggatttggagtttatatggcggacagaaatacagtaaatctttcggaacgaatgaaagtaacggtatgcttaaatccggttcattcagccacaggtccgcttggtgtcgtacttggatatgatctgttcgcacatatgcttaataccaatgaagatatgatgaagatggcaagaatggttgcttatgacgaaggacttccggtagtggcagatcctggaatcctttctccacaggcatttgtggatgaactttttaatgaccgttttccgaatgaatatctgggagatacaaatctccgtcttgcagttgatgtgtcacagatggttggtatccgttttggcgagacggtaaaagcttatgtggcaaaatacggagatgcatcaaaactgacagcaattccgcttggtattgcaggctggctcagatatatgctggcagttgatgatgaaggaaacaaattcgaactggcaccggatccgatgaatgaagaaatcggagaacagcttggtgacatcgtcgttggaaagccggagacattgaaagaccagctgaaaccgatcctgtctaatgaacgtctgttctttaccgatctttacaaagatggtgtcggtgaaaagattgaagaaatgtttcgtgaaatgatcgcaggaccaggtgctgtaaaagcaacgatccacaaatatgttcactaatcaggaagaatacgggaggaaatgaaaatgtcagaaacagtatttgcagcagatccgacaagactgctgatcgctgcggcagcgggaatcgtcttattattactgctgatcataaaatttaaatttcatccggtattgtctctgttgatttctgctctgttgatcggactcggagccgggatgccggttccgactctggtaaatacggtagaaaaaggtgcaggagaaaccttacagggaattgtactgctgatcggtctgggttccctgttcggaggtatattggaagtgtcgggtggcgcacagtgtgttgcacagacactggttaacaggtttggtgaaaaaaaagcagggattgcccttggaattaccggacttgtagttggaacgactgttttctttgaggcaggagttgtaatcttgattccgcttgctttcggactggcaaagaaaacaaaaaaatcaactttgtattatgtgattccgcttcttgcaggtcttgcaaccggatttgcctttatcccgccgtcagctggatcggttctggttgccaatatgcttggagtagatcttggaattatgatcgcagttggtgtgccgatcggaattttatcacttatttttgccggaattttatggtcaaaatttatcgggaccaagatccataccggacttccaactacagtttcagaagtaagggaagaggaagaagcaaatcttcccaaattttcaactgtcattgcaatcatccttgttccgctggtactcattctgtgcagcacactttcggaatatattccggcacttgatggaatacgaccggtactggaatttgtgggaacaccatttgtagcgctgatcattgcagttctgtgtgcaatgtattttcttggaaagaagcagggatatgacggggaacagctgaaaaagatcatggacagatctctccgaccgacaggacagatccttctggtcattaccggaggcggaatcattcgttgggtgcttcaggactgcgggatgggagacatcatcggaccggcactggaaaagagcggtcttccgttaatcttagttgcatttctgatcgctgctctggtaagagcatcggttggagcggcagtggttgcgatgacgatggcagccggaattatggcatccatgccggcggttgcaggactttcgccattataccttgcagcgatggtctgtgcgattaccggtggtgcaacggcattcagtcatgtgaatgattctggtttctggctggtaagctccttgctggaaattgatgaaaagacaaccttaaaatcatggacgatgatggagacgattatcggatttaccggtcttatctgtgccctgattatcagcatatttgcttaggaggaaaaaatgattgcgaaagtaatattgggaaccatgacaaatgcacggaaactggttagcattgcagagcggatttcctgtgacgtagagctttgcagtggcagatatgtggtcaatgcgaaatccatgctcggtgttttaagtatgcctaaatttgaatacggagaactgcatatccacacggacgaagaaaatgagtgcaaccaggttctggagagactgcttgaagaaggacttcttgcagataccaatgatgcggcaaaacggtcgctttacgacattacaacatttggtgagatcctgatcgattttacctggcagggagtaaatgaagacgggcagacactatttgcccagaatccgggtggcgctcctgcaaatgttgcagttgcggtggcaaaacttggtggacataccgcttttatcgggaaggcaggaaaggatatgcatggagagtttttgaaatctgtgctggaaaaagaaaacgtggaaacggaaggaatgcttctggatgaaaaatattttacgactcttgcgtttgtaaatattgatgagaatggagagagaacattttcttttgcaagaaaaccgggagcagataccagaatggaaaaagaagaaatcgatgttgatattctggataggacacatattttccatgtcggttctctgtcacttacggaacagccggcaagagataccacacattatgcgatccggcgcgcaaaagaaaaaggaagtattatctcgtatgatccgaattacagagcctctttatggaaggatgaggagactgcaaagaaactgatgagaagtctggttccttacgtggatatcatgaaaatttcagatgaagaaacgaagcttctgacagacaaagaaagtccggaagaagcgacagaaattttattccggaagggtgtcaagatcgttgcagtcacgctgggaagcgatggagcatatctgtactgcaaagaaggcggtgtacatattccgggatttgtgagcaaagcggtggacaccaatggggcaggagattccttctggggaggatttttatactgtatcagcaaagccggaaagagaccggaagcatttaccatggatgaactgaaagagtatgtacggtttggcaacgcggtggcaagcctttgtgtagagaggaaaggcgcgatccctgcaatgccggaacttgcacaggttgaagaaaggatgggacgttaagatggatctgaaaacatatacaacagggattcagcatatcgggattccgacaaatgatattgaaaaaacaattgctttttatcagaaactgggatttgagattgcacttcagacggtgaatgaagaagcagacgaaaaggttgcatttctggaactggaaacgcttgtgatcgagacttatgaaaataaggctgcaaagatggagagcggagcaattgatcatgtggcgatcaatgtgaaagatatcgaagaagtgtatcggtatattgaagccgaaaaaatgaacacaacgaaggataccattcatttccttccgttctgggataacggcgtgcggttctttacgattgaaggaccgaataaggagaaggtagagttcagtcagtatttataaaattgtagatttttcgatggcttattatgagcggatggatgaagcagtgagatatggaccggtttgcagaagagatatccgtctttatcgtgaacaggaacaacaaatttataaatatgtattggaaaatggctttattactactgctgaaacagtagagattttaggacagatgtaaaacatcgtagagccagagctgtcttgctgaatatggttaaggacggttatttgagaaaagagggtgcgacacgaagcgctatttatataaaaaatacagaagagagataatgcagcatggatacagaaaaagtaattactgtaaacggatcatccgcagatttgtcgtaaaatgtggtcaaatcaagaaacctccgtgcgaaagcaagtgaaaaatccctgtgaagctgagagatacgccatgcacagcccgggaaagaattccctcgctgccgggctgtcgccctataaaatagcaaaaatggacgcctttgcaagtggtatgctccccgtcaagaggacaataaaaaataataaatttttgtatcgtcagccatgctatggctggcgatattttatgctgcttttgtatattgctcatgatatttcattggtgtcattacatgcagtttcctttgaagtcgttggttgttgtagtaatctatgtaattagctatcgcagtaatcaaagagcttctgtcattaaaacgctgtttataatacatttctcgttttagaattccccaaaacccttccattggtccattgtcaatacagtgggcaactctagacatactctgcttcatatgatgtttttttaatctagtataaaactgtgcgcttgtatattgaaagcctcgatcagaatgaactaatgggtgtgcatctggctcctgacgaacagcctcatcaaacgtgtccataactaatggattatcattatgatcgctgattttaaaggaaacaatccttctatcatataaatctaaaatagcactcagataaactttatgaacttctattccgttgtagtatttaaattcagaaacatctgtaagccacttttcattcggtttttcggcgtgaaattcacggtgtaaatagttttttgctatgtgatcaggatttctgtctcctctggtacaactcttaggtttccatttaatatttgattttatatcgtatttcctacaaatacgaagtactcgtttatcattcacatgaattcctttatgtccatctaattcatcacgaatcctccggtatcccatatctggatgctggtgatgaatcctttggatttcagtggatagtctttcgtttcgaagttcattattacttttcggatattttccccagcggtaatacgcagaacgtgtaacattaagatatttacaaagtctatctatgggataatgcttagtagacgatagtttttggatggcttcatattcggctaaccgatggattaaagatagcgacccctcctttccagttctctgactttttttaacagatcattctccatttgtaggtctagatttcttctttccagttcagctatcttgtcacgtagctcttcttcaggtgttctgcttggaagagaagctatacgacgtccacgtctgtcttccagacccgcttgacccatcttttcgtatcgtattacccaattgcgaacttgttgataggaacaatcatatttgagtgccattgcaccataattcttatcatttgcaagacaatctgttactatttttaatctctcatcaagtgtagtgttctttgcctttttcatgtaagcacctccagtggatgtttttaatattccaccagaattatacaccttaatccaatcggaaagctgtctgtgtgaacgaattccgtattttgtgcaaatatcctgaagagatccttctccgttaagataatcatttatagcagatatttttaaatcttttgaataagatttgtttttcggttgattgagtaatccagttggtccatcatactgataaatagaaacccaatttcgaatactatgatgatcaactcccaattcttttcctgcttgctgtatgccaatttctcctgcaaggtagcgttcgactatttttactttttctactggttctatcttactctttctgaacatgaaaatacccccatataggacttttatatttcattgtcctatatgagggtagcatatcaaagtaaacttgcagggcgtttattttcaccattttgcatggctcgtagcgttcacaaaattttcacaaaataattagcactcacctcttgttattacagcgtagcttttgtcttagttcatagagtgccgtaaagtgcctatttacaggcttttcacgggttttatgaatttatcacatttcatcaaaaatcgtcaatatacaaaaaattggtgtcaaaattggtgtcaaataaccttaatttgagattttgatgagcaacacatcagtataaaaaattgaatattttatagattatggaacgcctaaaatgacgttccttttctatttccagccgttcttattggacggctattttattatccaaaatgaaaggagcattagatttatgaaaaagacatggaaacgattgtgtacgggcttcttagcttttgcaactgtcgttactgctttaccgactatacccgtccatgcagaaagtaagcaatactggacggaaagtgcagagcgtgtcggtatcattgaaaaagtaatgaatgatggttctatcggttcgacattcaatgagggctatatgaaagtcgagggcgaaactgcctattgtattgacatcaatacagattttaagaacggttacaagaccagagctgacgcaagctcacgcatgagtgccgaccagatttcagatgtggcgttatccttagagtatgtcaaacagtatggcgaagctcacaaggaattgaactataaacaagtctatctgttggaacaatgtgtagtttggcagagattgagcgtacatcttggctggcaatgtgataatgtgcgagcttcttatgatgaaattccaaaggcaacgcaggacgaagttttctctggtgcaaaagcctttgtcaaagagaataaaggacgctatgaatgtggcggttatatctactctggcgaggggcaggaattgggacaattctgggcgaagctgaatgtcggaaatgcgaaactgcaaaagacttccagtaataccagcattacagacagtaacgggaattactctgtcgctggtgcgacctatggtgtcttttctgataaggactgcacgaaacagcttgccacccttacgactgatgaaaacggaaatacagatgttgtagaggtaaaggctggcacagtttatatcaaggaattatctgcaccagcaggatataaagtagataaaactgtatattccttaaaggttgaagctggaaggacagcgaccttgaaagtatcagatacaccgaaagtaacagacactttgattaagcttttcaagattgatatggaaacacagaaagacaatccgcaagggaacgcttctctagccggtgcggaatttacatggaagtattatgcaggcttctataacaaagacaatcttcctgccgaagctactcgtacatggattacaaagacaatcgctgaaacagacagcgacgggacaactcattacatcacaaaattagcggacgcatacaaggtatctggcgacagcttctatatgcaggacggcaaagcggttcttccacttggaacgctaaccgttgaagaaacaaaagctccaaacggctacttgttagagggtgcatatatgcagactggcgataagtccgaacagataaaaagcttataccttacacagattaccgaggacggcgaccttgccgtattatctggaagtaaccagttttccgtatcagataaggttatccgtggcggtgtcaaaattcagaaacgagatttagaaacgggcgatacaaagccacaaggaagtgccactttgaaagatactgcttttgacatcatttccttaaatgataatgcagtattggttgagggcaagctatacaagaaaaatgaagtcgtaaaaactattcgtaccgatattgagggtgtcggttctacttctgctgacctcttaccttatggaaaattccgtatcgttgaaagtgaagctccaaacggatatttgacagacggtgcaaagccgattgattttacaatcacagaaaatggaaaaatcgtggacttaaccgacaaagcccattctatctacaatcagattaagcgtggagatattgagggcgtgaaaatcggtgcaggcacacacaaacgtcttgctgatgttccctttaggatcacaagcaagacgacgggggaaaatcatgttgtggtaactgatgataacgggcagttctccacttctgctgaatgggcttctcacaagcataatactaacgcaggcaagaccagtgaggacggtgtgtggtttggaacttctgaaccagacgacagcaagggtgcattaccttatgatacatacatcattgaagaaatgagttgtgatagcaacaaaggctttgaacttatcccaccttttgaaatcgtggtagcaagaaataatcttgtgattgatttagggactttgactgacgaatacgaaaaagaaatctctatccataccacagcgaccagcaaagacggcgaaaagactatccttgcaggaaaagaggttacaatcgttgatactgtcaaattagacggacttacaaaaggcacaaagtatcagttgaaaggctggcagatgttaaaggaagaaaacgccgagcttatcattgacgggaaacgtgtagaaaacgattatacctttgtcgctgatgatgaagaaatgaaagtggaaatttcctatacattcaatgcgtctgctttaggtggcaaaaaccttgttacctttgaagaattatatgatttcagcaattcagacgaacccgtaaaagttgcagaacacaaagacattgaggacgacgggcaaacggtacttatcacagagcgtatcatcaagatacatactaccgctaccgataaggacggcaacaaagagcttaaagcaggaaaagacgttacaatcattgataccgtaaccttagagggcttagaagtcggtacacagtacaaacttgtgggctggcagatgttgaaagaagaaaatgcagaacttcttatcaatggaaaacgtgtggaaagtgattacacttttattgctgacagcgaaactatgaaagtggaagttgcttttacgtttgacgctacttctcttgacggcaaacagcttgtaacttttgaggaattatacgatttaagcaatccagacgagccgaagaaagttaccgagcataaggatattgaggataagggacagacgattacttttaaggaaaagccagaagaaccagagaaacccgaaacaccaccgacaccggaaaagcctaacagacctagcgacagtcccaaaacgggcgacagtacaaatgtaatggtatttatcgtgatgttgcttgcgtctgctggtggactggctggaacatatctttacaaacgccgtaaaatgaagaaatcataaggcggtaacggtatgaggaaagaaaaatcacgctctccgccgaagctgtcaaacggcagatttttgcttattctggcttgtctgcctacaacctgcaagaacacggatagtcaagggtgcgtaagcattgattttaccctttactatctgggggattgctggtactttccaaaccgccagaataagaaatcacaattaaaaaacttatcaaatatagaaagaaacgaggtaaaacaatatggagatgaaatatgtcgtgccagatatggcacagtcttttggaactcttgaatttgcaggcgaaagcgagccagtctttgaaagagataaaaataatcgcagggtcttagccagacgaagctataacctttattccgacgtacagaaaggcgaaaatgttgtggtagaaattcccgtgcaggctggcgaaaagaagttcaagtatgagcagaaagtaaaacttgtcaatccgaagttatatggcagaggttacgcaatcggggatatgggacataccgattatgtattagttgctgatgatattgtagcagttgaagaaaagtaaaggagtgaagaatttatgagattatcaaacgggtttgttattgacaaagagaaaacatttggagaattaaaatttacagcagtgcgtgatgtgttcttacaaaatgaggacgggacaccgagtacccagcttaaaaagcgtatctatgatttgaagtgcagtctgcatggtggaattatccccgtgtccgtaccgccagaagtaccgttaagggaatttccttacaatgcagtcgtggagcttgtcaatcccgtagccgatacggtatcacgaaaaacctatacgggtgcagatgtagactggtatgtaaaggcagaggatattgtgttgaagaataaaggcaaccagaacgcaggcaatccacagaataataacacgcagggacaaccgaaaaaatagtaattgatatacctttcaaaaaaaagtgttgttcaattaaaatatactgttgacaatcaatgtactgtgtagtacgatatacctatcaagaaaacagtgaggtgaacaacatgaacttagacaaatggaaatctcaaatagtgcgaggtacattggaatattgtattttgctaatgctggataaaaaagtatattatgggtatgagattttacaagaattgagcaaatatcctataattacttctacggaaagtacagtatatccattgttaagaagattacaaaaggaaaactacttgcaatcaacttggcaagagtccacagagggcttgccacctcgtaagtattattcattaacaccagacggaaaaaattatctggacgctatgaatactgaatgggaaaatttattaaatgctatgtctgatttgaaaggagaataaaattatgaatactacgtttgaaaaatacttagatactattgataaatgtttgaaaccacttccaacttctgaacgtgttgatattgtaaaggaaataaaaggctctattttagaaatggaaagccaaaacctctcaacagaacaaattttaactagattaggaaagccaaaagaccttgcaaaagcctatcttggagatttacttgcaaaggaaaacaattttagctggaacagatttttaacagtttgtgctttttatagcttagtaggtttttctggattgtttgtaataccagttttagttattgttgcacctacttttattctgtgtggtgttgcttctgctgtattagggattataaaattagtagattatttattacatttgaatattccttatgtagattatattggttttcaatttggaaatacagctttaagccctatcccagtatttatcttatcactaatcacggggataatcttgttcttattaggacgaggtgcatggaagttattgattacctattgcaaaggtattagtaaaactaaaaacaatttatcaatttaatatgtatgtgtatttaagcagttagtcttaggattgactgctttttcacacccagaaaggagtgattgatttatgcgtaagatttggaacaaaggacaccgtatcagagccagcgacaagcaccttgtctaccacttttccatagggacgcttctgtttttgttcgtagcggttcttctgctactgaatatcaaacagctcatgcgtaccgattgggagcatttcagcttgttagagaacggcttgacgctctccccttacaacttcataaccatactgatagcgactggtgtttgtgcattggtcgcttttctgtattaccgcttctgttacgacagtttcaagaagctcctgcaccgtcaaaagctggcaagaatgatactggaaaataagtggtatgaagccgacaccgtacaagacagcggtttttttactgacctgcaaagcagatcaagggaaaaaatcgtctggtttccaaagatttattatcaaatggaaaagggactgcttcatattcgctgtgaaattacgctgggaaaatatcaagaccagcttttacggttagaggataaattggaaagtggcttatattgcgagctgaccgacaagaccctgcatgacggctatatcgaatataccctgctttatgatatgatagcgaaccgcattaccattgatgaagtacgggcagaaaacggctgtcttagattgatgaaaaatcttgtctgggaatatgacgcactccctcacgcccttatcgctggtgggactggtggcggtaaaacctattttctgctgacgctcattgaagccttactgcatacaaacgctgtcctttacattttagacccaaagaacagcgaccttgcggacttgggaacagtcatgccaaacgtctaccatactaaagaagaaatgatagattgcgtcaatgccttttatgagggcatggtacagcgaagtgaggaaatgaagcgacacccgaactataagacgggcgaaaactatgcctatctgggactgccaccctgctttcttatctttgatgaatatgtagcattttttgaaatgctggggacgaaagaaagcgtgagcctgcttagccagttaaagaaaatcgtcatgctgggacggcaggctggatatttccttatcgttgcctgccagcgtccagacgcaaagtatttctcggacgggataagggataacttcaatttccgtgtgggacttgggcgtatcagtgaattaggttacggtatgctgttcggttcagatgtgaaaaagcagttttttcagaagcgtatcaaggggcgtggctattgtgatgtaggaacaagcgtcataagtgaattttacacgcctttagtcccaaaaggacatgattttttgcagactatcggctttcttgcacaagcaaggcaggacgggacggcgacgtgcgaagcgaaaggcgacggcacggactagccgttgctggtgtggcgttagccacgccagcaggtaaaacccctcggtatctaacagaggggtacgtttgcaaatagacaatagacaaaaaacataggaaacataaggcttctggtatgatttcctagcaaaattcagttgtgaagtcgcttaaaaaaacttcacactttacagattgggggtatggttctgaatgaagaacaatggataaaagaattacgggagaaacgggttgcttacggtatctcgcaaggcagactggcggtggcttctggtatcacaagagaatatctcaacaagatagaaagcggaaaaatgaagccgtcaaaggaacttctggaaactctgcataaggaactggcaaggttcaatccagaagcaccgcttaccatgctgtttgattatgtgaaaattcgttttcccacgctggatatacagcatatcatcaaagatatattaaaactgaatatcaattatatgctccatgaagattacggacattacagttatacggagcattattctttaggggacatctttatctatacgtcggctgacgaagaaaaaggtgtccttttagagttaaaggggcgaggttgcaggcagtttgaaagttacctgctggcacagcaaagaagctggtatgacttcctcatggacgcactcatagacgggggcgtgatgaaacgtatcgaccttgctatcaacgaccatacgggcattttagatattccagagcttgcggaaaaatgcagaaaacgggaatatatcggaaaatccagaagttataagttttaccagtcgggcgagcttattaagcacagagaggacgacagagaatatatgggacataccctttatcttggttcgctgaaatcagatgtgtatttctgtatctatgaaaaggactatgagcagtatgtcaagttagggacaccgcttgaagaagccgacattatcaatcgttttgagatacggcttagaaatgaacgagcctattatgcagtacgagatttgctgacctattatgacgcagagcagaccgccttttctatcatcaaccagtatgtgaggtttgttgatgaagaaccagacaagcgaaaaaatgactggaaactcaatgaacgctgggcttggtttatcggcgataacagacagagcttgaagctgacgacaaagccagagccttacaccttagaccgtacattgcggtgggtacaacggcaggtagcaccgaccttgaaaatgctgaaaaagattgataaaggaaacggtacagactacatggaaacaatcgaacagcaggcaaagctcacagaaaagcatgaaatgataatcaaacagcagacgacccctgcaaaagatttggtggaaagttaggagtgataaaaaatgtgggtattattaaaagacttcctgctggtatctatgggaatgggtatcggcgtagtcttgatgtgtattttgaatgtcggcaaagaagctgactatgaaatgaaataattaaaagaaagcgaggacaattaaatgaatttcggacaaaatttgtatcaatggtttttatcaaatgcacagagcttggtgcttatgtcgatcgtggttatcggtatctacttaggtttcaagcgtgagttttccaaacttatcggcttcttggtagttgccttaattgctgtcggcttggtattcaatgctggcggtgtgaaagatgtactgttagagctgttcaataagattatcggtgcataaaatattgaaattatctttaattgcagagcaaaaaatgatatgataacataaaatctttcataaaaacaaaatacattctttcgtgctttttaagatttttactgtatcattttatttaaaattactgtgaaaggacgattactatgttatctacaatttatgctttgctatgtattatagttccttgttccttataccagcttattatttgcaagcgtcaaaacaaaaaacaagaaaacaaagcaattcattttgtatgggtatatatttttctgttatatatctacttgacgttctctgttgcaggtataggtagtatttgggatattggacattatgatacgattataagattagaggaaatcaatttattaccgtttcagtctgaggggataatgacttatgttttaaatattataatgtttttacctctgggctttttaattcctttaatttggaaacgatacagaaatcctctgaaaatttttatgataggcttcggtttttcattatccattgaactttgccagttattcaatcggagaaatacagatattgatgatttaatgatgaatacgctaggggcagttattggatattttatttggaaattgacaaaaaggttatttaaaaatattaaccataaatctatttctctttctaaactagaacctattgtatatttaactcttgcagttttaggagaatttctattattcaactggagaatttttctctagtgctaacaaaaatatttacacaaaaggcagttagtcttaggattgactgcttttttcgtacctaaatttcagattggagtgatgaaatgaacgatgtttttaaggatatgcaggtaaaagttggttgcgattatctttctgacctgccctcttacaagcgtaaggtgtggcatgaaatgaaacgactgaaccctgccaactatgaagaaagacagttagaagatttttcaaagtatgtgtttggtatgtcgtaccagaccataaaagatgtgatgaaacaacagaaaggacgtgaggaacaatgcaggaaacaagggtactggtggaaacgagaggaacaactggcgaagaaacaatatcatactggttcgacttgccgatagatgttgccgagtttgaagaaaagttaggtatcggtgcagaaagtggggattaccgtattatcgaaaaggtgttgccttatgctgatgaagtccacgaacatacaagcgtgtaccagctcaacgaattagattttatgtaccgccagctttcaagcgatatgcaggaagaatatgtatcactacttaaggtgtttgagaatttagaagcactttatatttgcaggaacgtgattacggtttatcctgactgcaaaagcatgattgatgttgcaaggcaaaagttgatgaacgacccgacatttaagcatttatccgaggactgtcaagaatattactttgactttgaagcctatgcttctcacttgcaggaacacgggaaatttttagtaacagaacacggtatctttgaactgccagagtaagaaatgaggtggtgcttatgattgatgatatggcggtttacattgctaatcttggcaaatacaatgagggctatttagtcggtgcttggttcacgttccccattgacgaagaagatgtgaaagaaaaaatcggcttgaatgaacagtatgaggaatacgcaatccatgataccgacaacttccccattgcgattggcgagtatgtttccattgaagaacttaatgagatgtatgaaatgatagaggaacttcccgactatatcgtagagtgtctggacgaatttatcagccactacgggacgctggaagaagtcgtggaacacaaggacgatatttattattatcccgactgtgaaaccatgacagacgttgcctactactacatagacgaattgcaggcacttggggatattccacccagcttgcagaactacattgactatgaagcctacgggcgagatttggatatgggcggttgctttattgaaacaagccgaggtatgtgcgagataccatattaacgctggaagatcagcgacaagcattgttgctactgacagcgtatttctcttttaagggacagtctgaaaatggctgtccttttctctttgaagaatttacgaaaggagctgaaagaacttgaaaaagattaaatcttatacgggtatctggaacgtggaaaaagtcttgtatgcaatcaatgactttaacttgccctttcccgttacttttacacagattacatggtttgtgattacagaatttatcatcattctgtttggggatattcccccactttccatgattgagggagcatttctcaaatactttggtattcccgttgctctcacttggtttatgtcgcagaaaacctttgacggaaagaagccgtacagctttttgaaatcacagataacctatgccctgcgacctaaaatcacttatgcaggaaaagccgtaaaactgcataagcagatactcaatgaaacaatcacggcagtaaggagtgtgaactatgttcccgataaaatatattgacaataaccttgtctggaataaggacaatgaggtgtttgcttattatgagctgataccgtacaactattctttcttatccgcagagcagaaatttatcgtgcatgacagctttcgacagctcattgcacagtcccgtgagggtaaaattcatgcgttgcagattgccacagaaagctcaatacgaagtatgcaggagcagtcaaagaaactggtaacgggaaaattaaaggaagttgcctaccagaagatagacgaacagaccgaagcgttagtatctatgattggggataatcaagtggactaccgcttttttcttggctttaagctcatggttacggaagaacagctcaatctgaagaacatcaaaaaatcggcgtggctgacgttcacggaatttctccatgaagtgaaccatacgctgatgaatgattttgtttccatgccgaatgatgaaatcaaccgttacatgaaaatggaaaagttactggaaaataaaatctcccgtcgctttaaggtgcgtcgcttggaaatcaatgattttgggtatctcatggaacatctttacggcagggacggtatcgcttatgaagattatgagtaccagctaccaaagaaagaattgaaaaaggaaacgctgataaaatactacgaccttatccgtccgacaaggtgtgtgattgaggaaagccagcggtatttacgattggagcatgaggacaaggaaagctatgtgtcttattttaccgtcaatgcgattgtcggggagctcgattttccgtcaagtgaaatcttctatttccagcaacagcaatttacttttcccgttgatacttccatgaatgtagaaatcgtggagaaccgaaaagcattaacgacagttcgcaacaagaaaaaggaattaaaagatttggataaccacgcctatcaagcaggaagtgaaaccagctcaaatgtggtggacgcattagacagcgtggacgagctggaaacggacttagaccagagcaaagaaagtatgtataagttaagctacgtcatacgggtgtgtgcacccgatcttgacgagctgaaacgccgttgtgatgaagtcaaggacttttacgacgacctcaatgtaaagctggtgcgtcctgctggggatatgctggggcttcattctgaatttcttcctgccagcaagcgatatatcaatgattatgtgcagtatgtaaaatcagacttcttggcagggcttgggtttggtgctacccagcagttaggggaaaacacgggtatctatatgggttattccgttgatacgggaagaaatgtgtatctgcaaccgtcccttgccagtcaaggtgtaaaaggtacagtaacaaacgcccttgcttctgcttttgtcggttcgcttggcggtgggaagtcgttctgcaacaatcttctggtgtattactccgttctctttgggggacaagcggttattttagacccaaaatcagagcgtggcaactggaaagaaacactcccagaaatcgcccatgaaatcaatatcgtaaaccttaccagcgacaaggacaatgcaggacttcttgacccattcgtgattatgaagaatgtaaaagacgctgaaagtctggcaatcgacatcttgacattccttacgggtatttcttctagggacggcgaaaaatttcccgtacttcgtaaggcggtgcgttccgttacccaaagcgaaaaaggaggactgttacacgtcattgaagaattgcgaaaagaagatacaccagtatcaagaaatatcgcagaccatatcgacagttttacggactatgattttgcacacctgctgttttcggacggtacggtagaaaatgctatcagtctggataatcagctcaatatcattcaagtagccgaccttgtactgccagataaagataccacttttgaggaatacacgaccattgaattattgtcggtgtctatgctgattgtgattagtacctttgcccttgattttatccattcggacagaagcatttttaagattgtcgatttggacgaagcgtgggcgtttttaaatgtggcacaaggcgaaaccttatcaaataagctggtgcgtgctggacgagctatgcaggcaggcgtttattttgttacccagtctgcctatgacgtgtcaaaggaaagtctgaaaaacaatatcggcttgaagtttgcatttcgtagtaccgacttgggcgagataaaacagaccttagaatttttcggtatcgacaaggacgacgagaacaaccagaaacggcttcgtgatttggagaacggacaatgcttattgcaggacttatacgggcgtgtcggtgtggtgcagatacacccagtctttgaagaactgctacacgcctttgataccagaccgcccgtacagagaaatgaggtggagtgatgaaagaaaggataaaaggtgcgttcacaaaaaagaagattttccactttctcaaaatggctctgttcgtggtggcactctcccttatcctgctttcacttctggggacggtggctcatgcgacggggcttgtggacgataccataaacgcagaaaatctttactcaaaatatcccctttccaactaccagcttgatttttatgtggataatagctggtcgtggcttccgtggaactggctggacggtatcggaaaatcggtgcagtacgggctttactgcattaccaactttgtctggacgataagcctttatttaagcaatgctacgggctatgtggtgcaggaagcctacaaacttgattttattaacgatatggcagacagtatcggaaaaagcatacagacccttgcaggtgtaacacagaacggcttttcttctacgggcttctatatcggttttctgcttctcattatcttagtggtgggactttatgttgcctatacgggactgataaaaagagaaaccagcaaggcacttcacgccgttatcaactttgtggtggtattcgtgttgtctgcttcatttattgcctatgctcccgattacatcaaaaagataaatgagttttcatcagacatcagtaccgcttcacttgacttgggaacaaaaatcatgctccccaactctgacagtgagggcaaggacagcgtggacttgatacgggacagcttattttccattcaagtggaacagccgtggttactcttacaattcgggaacagcaacgcagaggaaatcgggacagaccgtgtggaagctctcgtatcggcaagcccagaggacgaggacggcaagaccagagaggaagtcgtgaaaacagaaatcgaggacaacgacaacaacaatctgacgataccgcaggtcgtgaaccgtttaggcatggtgttcttcctattgttttttaacctagggataacgatatttgtattcttgcttacgggcatgatgttatttagccagatactttttattatcttcgctatgtttctgcctatcagttttctactctccatgataccgagttatgaaagcatggcaaagcaggcaatcgtaagggtgtttaataccataatgacacgggcaggaataacgctcattgtaacggtggcgttcagcatttccagtatgttttataacatatctacggactatccgtttttcatggtggcgttcttgcagatagtgtgtttcgctggtatctacatgaagctgggcgacttaatgagtatgttctctttgaatgctaacgacagtcaaagcatgggacgaagaattttccgcagaccatatctatacttggcacatagggctaggcgtatggaaagacggcttgctggtgcggttactgctggcggtgtcgctggtgcggtggcaggtagcacgatttcaaacagaaaaccgacaaggaacacagctacaaaagacagtcggggcaataccacttccagcatgggacagcgtgcaggctcaaaggtgggtgctgtcttagatacgaaaaataaagtgaaagacaaggcaaatgctgtcaaagaaaatatcaaggatatgccgacacagaccgcttatgcggtgtattccgcaaaggaaaaggcaaagtccagcgtgtccgacttcaagcgtggcatggtgcaggaacagcagtccagacagacgggacgattggaaaagcaggaacagcatagacaaaatatcgctgacaagcgtatggagcttcaaaaggcacaagaaacaaggcaggcacagcgaaaggctgacggatcagcgacaacgggagctacccgtccccatgagcgaccagccacagcttcaaccattccaaagccgagtgttgaaaaaacgcaggaagtcaaacgtcctgccacagcgaccacttcaaaagcaagcgagccagtcaagacaaatgttatcaaagagcgtccattatcttctggtgcttctgataggaaagcgacccagtctgcacagccagtacataggcagaatgtagaaaaagtggtatcgcaggaaacacgccagaattacacaaaagaccgtaggacaaaggttcagcagacgcaaaccgtccaaaagaaccagcagacaacagagaaaactcgtaaccttgtgatgaagaaaggacagaagaaaaaatgaaactgaaacatatcgctatcattggcagtctgtttcctatcctcttttctatggtgcttttctttggtgtgttgattagtgcggacagcgacgacgagaacagcaacttttcttctggcattacgggtatgaatttgtccgcagaagtcttgaaacatcagcctatggtagaaaaatacgccagagaatacggcatttccgagtatgtcaatgtgctattggctatcattcaagtagaaagtggcggtacggcagaagatgttatgcagagttcggaaagtcttggcttaccgcccaactctttagatacggaaagctcaatcaagcaggggtgtaaatattttgcgtccctgctttcttcctgcaaaaatcaaggtatcgacgatttgaatgtagcgatacagtcctataattacggcggtggctatgtgggatatgtggctggaaacgggaaaaagcatacctttaatcttgcagaaaattttgcccgtgagaagtcgggcggtaaaaaagtaacctacaccaacccgatagccgttgcgaagaacgggggctggcggtatggctatggaaatatgttctatgtggaattagtcaatcaatatttgactgtggcacactttgataatgcgacagcacaagcgattatgaatgaagcgttgaaatatcaaggctggaagtatgtgtatggtggcagtaacccgaacacttcctttgattgtagcggacttgtgcaatggtgctatggaaaagttggtatctccttaccgagaaccgcacaagcacagtatgacgctacccaacatcttccgctttcgcaggcaaaggctggggacttggtgttttttcattctacctataacgctggttcgtatgtaacccatgtgggaatatatgtgggaaataacaaaatgtaccatgcaggcgacccgataggatatgcagacctaagtagtagttactggcaacagcacttaatcggtgcaggacgagtaaaacaatagaaaggacttgaaaaatatgtttaagaagaataagaaacagacagaaaatgtcaaagaaaaaaaggtgcgtactgtcaaggtaggtatatataagaaaaccgtgattgcgttatgggtggtgcttatcgcaagcgtgagctttggggtatataagaattttaccgctatcgaccagcacacgacccacgaaaaagaaatcattgagcttcgcttgcaggacaccaacgggattgaaaattttgtgaagaacttcgcaaagtcctattacatatggaataacagcaaagaagcgattgaagcaaggacgcaggcaatcagcggttatctgacaaaggaattgcaggacttgaatggtgatacaatcagaacggatataccgaccagctccacagttacagatgtgattgtgtggagtatcgaacagttgggaacggacactttttctgctacctacgaagtagatcagcagataaaagagggagaacagacaagcaatgtgaaagcaacctataccgtaaaagtccatatagacgctgacggggatatggtaatcgttcagaaccctacccttgcaccagcaatcgaaaaatcagactatgagcctaagacatcagaagcagacgcaagtgtagacgctgatactgtaaacgacgctaccgcatttctggaaacattctttaagctgtacccaacagcgacggaaaaagagcttgcttactatgtattgggaaatgtgattgaacctatcggcagggactacatttattctgaactggtaaaccctatctttataaaggacggcgacaatgtgaaagtcaaggttgcggtaaaattcattgataatcagacaaaagcgacgcaggtatcgcagtatgagcttgtgctacataaggatagtaactggaagattgtaggataaatgatatagcgtgcatttcctatcagatttgcacgcttttacaaaacgacaagaaaactgtgcaaaaatattgacttgtaatgaccgaatgctataatataaatgacaagtgtacttggtattatttgaaaggagcgttatataatggataaagaaaaaatactatcacaaaacaaaaaagagaatctatatcttgatgaatacgaaaaacatattaaacttcaagggaaatcttttggcttaatgtttgttttatttatctgcattttaattcttttcattaaagcagtttgtaaagaaccttactatgacataatgacaattattgggtctgtggcatttggctctatgggttatgaagcacatatttcaaaaaataaatccaaatttgttattgctttattctttcttctatttatggggtattacttttataaatttttaatgataggtttatagaatggacgaacatttaattttgcgaaacagattaaaaactgtacgaaaagaaaaaaaattatcacaaacagaattagctgaactagtcggggtttctcggaatacaattagttctattgaaactggacaatttaatccaacagcaaaattggcattagtgctttgtatagctttagataaaaaatttgaagaattattttattttgattaaaggagagaacgattatggaattagaggaattgattgttgaaatagttataggattgtttttactttttacatcttatcaaataggaataaaagagaatattactttattacatggttatcattatacacaacttgaccctaaagataaaaaggtgtttacaaaaaaaataggaataggcactttactggttagtattggtattcttgttatgccgattatcaatttaatctctcattctgaattaggctattacataggtcttattttgattgttgtaggagtgttttatatcatattcatcattgtaaaatacaacggaaaacttattagctttaaaaagtagaattgaggtatgaatatgataggactgaacaaaagagatataaaaaaggcattgaaagctggtgcaaaggctggcggtgtatcattggctgatgttcgggcggatatagaagctacgattgatgaagctattaacagcaccgacccagaagtgcaggcaaatttcaaaaagtattttggaaataaacgccctacaccagaggaatacatttataccattacgaaaaagacaaaggtaaaattataataaaagggtcgtggaaatgcttcacagaattgtgatctgcattatcacggctcttttactctctgtttactttcaaaactgtaagtgtaattgaatactgcccttgctataatttaattgtattccaaaacaaataaatgtggcaggaagaaaggagcgatttttaatggaacacattttaaatttagagcaagtaaaaaaatactatgggggtaattctggaaatatcacaaaggcagtagacggtatttctatgtatgtagacaagggcgaatttgtcgcaatcatgggagctagtggttctggaaagactaccctattaaactgtatctctacgattgatactgtaaccagtggacacattacagtcaataatcaagatattacaaaaatcaaggataaagattttgctgatttcagacgtgaaaatctagggttcatttttcaagatttcaaccttttagatactttaacgattgaagaaaacatttctttgtcattggtaatcaacaaacagaaccctgctgatattgacaaacgagttcatgctatcgctgataaattgggtattcgtgatattttatcgaaatttccttatgaagtttctggcggacaaaaacagcgttgtgcttgtgcaagagccttaatcaatgaaccgaaactgatattagctgatgaaccgacgggagctttggactcaaaagcttccagattattactggaaacaatgtctgaaatcaacaagaaaatgcaggctactattttaatggtaacacatgacccgtttagtgcgtctttctgtgaacgtattttgttcttgaaagacggtaaaatattcaatgaaattttcagaggggaaaaaagcagaaaagatttcttcaatgaaatactggatatattaaccttgcttggaggtgaagtgggaaatgttaggtaagttagcgtatagaaatacaaaaagaaatattaaagattatttgatttatctgataaccgttactgcatccgtttctcttatatttgcttttaatttggtggcaagctctgatgaaattgtaaagttatgttccagtatggatgcatttaagaattcattgttcgctgtaaatatccttattatttttgtgatatgctttttgatcaactatacaacgaaatttatgtttgaaaaaagaagtaaagaattaggaacatatatgcttcttggcattaagaaaaaagaaattgcccacttagttataattgaaaatatactgttgggaattttagcatttgtattagctattcctattggctttttattcagccagtttgtgtcgttagtaattgtaaacttactgggtattccaaaaactctctttatttctttgaattttgtttctattggactattgataatttgttttttaactatttatgttttggttttacttaatctattaagaagaataagtaaaatgacgatacgtgattttctttactttgataaacaaaatgaaaagaaaatgttccgtgacagtaaaaaaagaaatgtcatttttgttttaagtattattcttggtgcgatttctctttttctctggaattcacgttgtactatggataattttaataagcaagaaacacttacctatttgatggtgagcgtaatcatgttgattatcagcatttatggtatatctacaacttgtgcagatatgttcttgactgttttgttaaagaataaaaaaatgaaatatcaaaatgacaatctgtttgtagcaagaacatttgcttctaaagcaagaacaatgagcttcacatttggtacattgtctatgttgattttaacttcactgctggctctgaattattctagtatcaacaaagcttcgtatgatatcagcgtgaatttaaatgcaccatatgatgtacaactctttgatgataagcaggtatttgatgaatatattcgagtaattgaagaagaatatacgattgataataccattgagtacgacatttataaagagccgaatcatcaggtacaaaatttcttccaatcagaatattatgattttgacccagtcttgaagttaagtgattataataggttactagaattaagaaagatgccgttgctttctttaaatgataacgaatactatatagttacaaatagcaagtttgcatatgaggttgaagataacaaagacattgaaactataacagtagcaaataaaaatttgaaattaaaaggatatgacactaagtcttattggaactctataactaatactggcagatttgttgttgtacttccagataaatatgttcaaggacttgaagtatcagaaaatcatttgattatagatacaaaagaagaaacagatgcagaattagaaaacaagataaaagaagatatgcaacatcaattagtaaaggttgataaaaatggagaaataaatgacgaatcgtatagagtaaatgtaagaggtgcagaaatagaacaacaaaaagcaatggttgcaatagtagccagtctgtttatgtacattgcatttatcttgatttccgcagtagggacaattttggcagttcaatcattgagcgactctactaaatacaaatatcgctacttgaccttgcgaagattaggaataaatgataagtcgctatttaagacaatcagaaaacaattattgatattattttgtgtccctgcaatatcagcaatattatgttcttttgtgatgatgtcgtcattgaataatgtgtatcaacaaattttgggagataaacacctttatctaatctactttggcttgaatttaattatcttcttcctaatttatagtatttactggattgcaacgtatattggttttaaacgaaatatcaacgaggagagttagacttttctagctctcctactgtgaaattattataatgataaatcaagggggtgttgaaatgagaatagcaattatcgaagatgatgaaatcactcgtttggagctttctaaattattgaacacacaaggatatgaaacagttttattgactgactttggaaacctgacagatgaattaaagcaatattccatagaactggttctgcttgatattaacctgccgtatgagaatggctatgaagtatgcaggaaaataaaacaagtcatgccagtaccgattatctttgtaacaagcagagatacaaatgctgacgaattgaaaagtattcaagtgggtgggattgacttcataacaaagccgtatgacacgcttattcttcttgagaagatcaagcgtgcattgcagttgtcaaacccgaataatttccgtgagcttgtcaaaaaagattgtacccttgatttacatttatccattttgaagtatcaagagcaaagcattgaactgacaagaaatgaatttcgtattttgtactacttctttatgaacgaagataaagttattagcaaagaagaactattggaaaagctgtggaatgacaaatattatatagacgaaaatgtattattggttaatatgacccgtctaaaaaagaaaatgaaagaaatcggtattgttcatttattggaaaatatacgaggaaagggttggaaactgtgagtttttttacattcttagaagaaaaaataacagagatattgtttcagcttttctttcttgccgtagtagcatttctcttgattttctacggtgtagatacgctgtttgttgtatcgttggtaattctgttcatcagcatacaagggctttttcaatggtgtttgtatcggaagaaacgtaacgtttcacaacatattattgatttagtagacggactggaagaaacctattatattgcagacgttttaccaaagccaaaagaatttcaaaataaagcctattgctacgcactaaaaaaagcctgcaaatctatgaatgatgaaatcggcaaaatcacagaggaaaagcaggactatcaagaatatgtggaaagtttcgtccatgaaattaaaataccgataggagcattgtctttgacgtttgacaatacaaaaaattacacattaaaaaaagaaacagacaaaatatttcagttagtggaacaaatgctctactatgcaagaagcgaaaatacggaaaaggactattttgtaaaacagttgcagttagacgaagtgatacataatgtcattctgaaattccgtcattcgcttatggaaagaaaaacaattatcaatatccatgacatagaaaatgtcatttatactgatgaaaaatggctgacattcattctatctcaaatcgtgcaaaatgcgattaagtattttgataagcaagaaaataaactgacgatatacagtcaagacaatggtacaaatatattgtttgtgattgaagataatggttgtggaataaaagcgtctgatttatcccgtgtatttgaaaaaggttttacgggttcaaatagaaacaaggcaaatgcaacgggtatgggactgtatctatcgaaaaaattatgcgataggttgggcttgaaattggatattgcttctacggaaaaagaatatacaagactgaccattacatttccaaaaggaacagttcataatttttcagagtaatttgaaaaccatgccaacattgatacggtgctttaagggggcttgcattatggaaaactttaagtacaattatttgcaatcaaattccacctaatagcacactattaaaaattgaatatgttttagctttaaaggctcgtacagactatatgttttgtgcgggcttttttcatacccgaaaaaaatttaaaaatttttcaaaagaggtcattaaatcacacctttcattccctatatggtgcggaaagagggataaacacttttcaaatcatagtggaaagggggtgagattgatgaaaccgtctgacttccagaaaacagttcaatgtcgctttgaaagttgtttgaagaaagttgtccgtcatgttgtaaaggactaccaacaaggattgaaacgacgaaaagataaagaaattccattctgtgaacttccagaaattttcgttgaaaattttgctgtgagggacgactacgaaacagattatacaatcttttcagtatgtggcattgatattcgtgtccttgatgatgagctggcagaagccttgaaaaaacttccagaaagaaagagaaatactctgttaatgtattacttcttggaaatgacagaaagtgaaattgccaacttacaaaagattacgcaaagcggtgtatttagaaaccgacatcatgctttggaaactatgaaaaaaatactaaaggagaagcagtaaaatgaagcaaacatttaagaagccgtcctactatttgctttcgcaagcaatggacggggacgaaaaagcgattgaaaaaatactggcattttatgacccgtacatatcaaagtgctgtttgcgcccactttatgatgaatacggcaatgtctatattgttgtagatatggagttaaagggacttatccgagaagcacttatcaaaatgattttagggtttgatattgccttagaaatcgaagaagaataagcagtttttagcagaccatggtttaatgtccccctctttcctgctctgccctgcttttacatgaaagcaacacgctttcgccacagctctttgacaactgaataaagcagacagatacgtttgcgagatagcgagccacggggactgtacgccacgacctttccaaaagaaagcgagcgacccacgcagtgatccgagagcgactgttggaaaagtcgttttgccatgacctatcctcacagaataatgatacgtccgcatggtgcggttctgcccacaagaatgggaatagttgagatactaatggagctttccaaagccgtctgtctgcttatgtaacttataaatagacacacagtaaagggggtgttacattatgttaaatactgatgtgttaaatgatgtgatgttccagcgaggtaaggtgttggaatatgaataaaacgaagataagagcaacggaacagccgattgctgttgatatagagggactgtctgctatgttatcttgtggtcgtgctactgcaagaaagattggcgagcaggcaggagcaaaaattgtgataggtcgcagggttctttattccatagaaaaagtcaagaaatacttgttatatttggaagaatagagcgattttctatttatgttctctggcgtgtgtagtataataagaaaggacaaagcacgctgtgagaacaagaaaagaggctttttcagaaaggaatggttctcatggcaattagtagaaaagacccaaaaggaagaaaattaagagagggcgaaaactggcgtaatgatggaagatacagttatcgttatacagatgtaagaacaggcaagagattgacagtctatgcacaagatttaccagagcttcgagaaaaagagaagcagattgcaaaagatatggaagataacatattgacagacggagcaatcaaaaaaatgacgctcaacacgttatttgagcgttatatggaaactcgtgagctggctgatactacaagagttagttatgttcgtgcttgggaaaacagagtaaaagacgagattggaaatattaaagttgttcagcttttaccctcacatattaaagcgtattatgcgaaactttccaaagctggatatgcttattctacaatcaagtatattcacaacctgctttatcctgcattagaaatggctgttgatgatgatattatccgaaagaaccctgcaaaaagttccattagtgattatggaaaaacagcagaggaaaaagaagccttaacagtttctcaacaagaaaagtttatggagtttgtaaaacagagcaatgtctataacacatattatcctatgtttaccataatgattggtacggggttaaggtgtggggagcttattggtcttacatggaaagatataaacatcaaggcaaaaacggttaatgtagaccaccagctcatttataagaatttaggcgacggttgcaagttccatatctctacaccaaaaacggagtcgggtattcgtattatacctatgacacaagaagttgcaaaagcctttgaggaacaaaggaaaatcaattttatgcttgcaaaggataagagcattgaggtggacgggtattcggggtttgtctttacagcaaaatcgggcagaccgcttatgccgaatggcgtaaatagtgttttatacaacattgtagacgcatataacaaaaccgaagtagagagagcaaaaaaagagcataggaaagcagagctgttaccaaagttttcagctcatgtaatgcgtcacacagcttgtaccagaatggcagagtgccgtatggatgtaaaagttcttcaatatattatgggacacgctcatatagatgtaacaatggaagtgtataaccatattggagagctgacaaggattgaaaatgagattgcaagactagatagtatggtgttaaatgcttgacaccacaaaaagagaaattggtgtcaaattggtgtcaaaacagaaaaaatcacaatttcaaaagaaataagatactgcaaaccattgattttaaagggtttgcaaaaaaaatctcaaaaaattagcactcaccacttgacagtgctaacaataagtgttatattacagctagaacaaaggaaggggaacaaaaagagatgataaagattccaccgaccggtgtttgagatgacaacaacacttcagagtaaatccgaatgtgctaaataaattaataaatgtcttttgaaaggagatatgacttatgttaatgcctagtatttttggagagaacttattggatgatttctttggagaaccatttggaggatatgattacagtgaatccggacttatgacaacggatgtaaaagataccgataaaggctatgaagtaacgatgaacatgcctggagttaaaaaagaagatgtaaaagcagaactgaaagatggttatctgacagtcagtgctgagacgaacacgaagaaagatgaaaaagctgaagatggcaagtacatccgccgtgaacgttacagtggatcctgcagcagaagcttttatgtaggcgacggtgtcaaacaggaagacatcaaagccaaatttgaagacggtacattgaaactgttcgtaccgaaagaagcagcaaaacctgctgtagaacagaagaaatacatttccattgagggataatcagaatgcggattgtaagcgtccggttacaaggctgccagatgaggcagccgcttaaaaagaaagttagctaaattcagatagatttataaggaggaacgacttatgttaatgcctagtatttttaatgataacttatttgatgatttctttgattttccattttatgatgataaagcagatcgtaagatccagagaaaactgtatggacatcatgcaggcaatctgatgaagacagatatcaaagagaaaaaagatggatacgaactggagattgatcttccgggattcaagaaagatgaagttacagcagaactgaatgacggatatctgacagtcagcgctgccaaaggactggatcaggatgagcaggagaaagaaactggtaagtatatccgtcgtgaacgttacgcaggagcctgccagagaagttattatgtaggtgaagatatcacggaagaagatatcaaggctgagtttaagcatggtatcctgaaactctttgtcccgaagaaagaagtaaaaccggcagtagaagagaagaaatatatcagtatcgaaggataatgacaacacgttaaaaactttcaaatacaccatatgatgagggcagcatacaggagcaaaatcctgtatgctgccctttttgccatctatataaatggaaatttgagaaagtctggatagtataatgaagttaggatttgatctgtattttgagatgtggaaaaagggagaaatatctatcagaaaagctgtatagtagtggtgaatcgaaaaataaaatctgagagagttttcgaatgtgggaatcggagaattacagataatgaaaaatcaaccatgggaaagggaatgtttagtgttatggcatggacattcccttttctggacataaggataataagaggaacagtttgctggcatcgacaagatgtattatagaaaaagccctgctttatgcaaggcttttgaagtatgagaaagattttcatttaccagattccaagcacatgctgcatggaaagactggcgatcgtgataccgatccaacagcagaaaccaagagcgagtggtttgccgccggttttgatcagcttgatgatattcgtattcagaccgactgcactcatggcgaggacgatgaagaacttgctgagtgtcttcagcggagtaaatacatctgcggatacgccggctgaagttgcgatcgttgtgatcacggaagcgagaacaaagtagaggatgaacatcgggaaaatctttttaaattccactttctttccttcggctttggagctgcgtgtccggataaatgcgagaaccagtgtgatcgggatgatcgcgagcgttctggtaagtttgaccgtaactgccttatccagtgtggcagaaccgagggcgtagagcgaatcccaggtggaagctgctgcagttacggaagaggtatcgttgatcgcagttccggcaaagataccgaaggcttccccgcttttggttgaaaatccaagcagtgcaccaagtgacgggaagaacagtgcggcgagcatgttgaaaaagaagataacagagattgcctgtgcaacttcttcatcatccgcatcaatgaccggtgctgttgcggcaattgcagagcctccgcagatggaagatccgacaccgaccagtgtggaaatatttcccggtacatgcataactttatgtaacagatatgcaatgatcagggacgttgaaatcgtcgttacgataattggcagtgactgttttccggtttccagaatcacggagagattcagtccgaaaccgagaaggattacagcgtactgaagaaccttctttgacacaaaagtaataccgtcctgaaacatggatttgtcttttaataataaagtaatgatcattccggcaaggataccgaataccggtccgccgatgatcggaaatgtctgtccgaggaaccagcatggaacggcgatgaccagacaaagtaagatgcctttccagctttttgttataaaattcatagaaatacccctttcaagtgaaataaataagttactctcataacaatctgtcctatcatagcataaaaacagcagaataaaaagatgaaggaaggaaaatttcaaaagtaatttgagaataaggtggaaataatgaaagattcccgatataataatatgtgattttggggacaaggaggtaaagtgtgataaaacggggaatccggacattgcacaaaagaaagtgatgcatacactgaaaaaatttgtaaaatattatgcgccgtacaggacagtattctttctggatctgatctgtgcggcgatcatcagtctggtggatcttgcatttccacagattttaagatcactgacaaagactttatttacagaggatccgtcacagatccttggagcacttctgccgatcggactggctttgcttgtgatgtatatcatacagacattttgtaaatattatgtcagttatcagggccatatgatgggggcacatatggaacgggatatgcgccagaagttatttgatcattatgagagactttctttttcttattatgaccagaataattccggacagatgatgagcaagctggtgtcggatctgtttgatatttccgagtttgcgcaccatggaccggagaatttatttatatccgtaattaaaatcgttggttcgtttacatttttgtttcttattaactggagactggcgattccgctgcttgtgatggttgtatttatgctgatcttttcttataagcagaaccgtcagatgcaggagacttttatggacaaccggagaaagatcggggatgtcaattccagtctgcaggatacacttgcgggaatccgtgtggtgcagtcttttgcaaatgaaaagattgaacgggagaaattcgagaaaagcaatgaaggatttctggtatccaaggatgcaaactatcattgtatgggaagctttatgagtggcaatcttttcttccagggaatgatgtatctgatcacattagtgttcggcggatggctgattgcacatgggaaaatggaagctgccgatcttgccatgtatgcgctttacatcggaatttttatcagcccgatccagattcttgtggagcttaccgagatgatgcagaaaggtctttccggtttccggcgctttctggatgttgtggagacggagccggagattgtaaatgcaccggatgcggagccacttgaaaatgtaaagggtgaagtggaatataaaaatgtttctttccattacagcgatgatgatacgccggtactggatcgggtatcttttaagatcccggctggcagatccattgcccttgtgggaccgtcgggaagtggaaagacgacgatctgttccctgcttccaagattttatgatgtgaccggaggtgtgatcacgatcgacgggcaggatgtaagaaagctgacactggaaagtctgagaagccagatcggactggtacagcaggatgtctatctgttctgtggatcgatcagggaaaatattgcttatggaaaaccgggggcatcgatggaagaaattatcgatgcggcgaagaaggcaaatatccatgaatttatcatgtccctgccggatggatatgacagctttgtaggagaacgaggaacccgtctgtcgggtggacagaagcagaggatttcgattgcaagagtatttcttaagaacccgccgatattgattttggacgaggcgaccagtgcgcttgacaatgagagtgagcgctggatccagcagagcctggaagagcttgcgaagaaccggaccacgatcacgatcgcacaccggctttctacgatccgcaatgcggatgagattcttgtggttgcaaataatggaattgctgaacggggaaatcatgatgaattgcttgagcagggtggaatttatgcgcattattatgagatgtcataatagtaagtgagaaaatcaaaataagtaaacaaaaaagcttcttttcagaaaaacaggagggccgtttctgaaaaagaagctttttatatcgtaaaattgtaagcagtgtgtgctggtctatatttgcaaaacattacacagcttagtcacacatatggcaggctgcgcatgcagacggtgtcgttgcgcatccgccgagagctgtctcccgaagctctgccggaagacgctttcctacagtgtacaccgcttccagcatttcatcgaatggaatcagctggcgtactccggaaagggcgatctctgcagcaatcgttgcatttgccacaccggcagcattacggttctggcaaggatattcgaccagcccgccgaccggatcgcagaccagaccgagcatattcataagaacagtggatgctgcggcaagggattgttccggggatccgcccatcagttcaacggttgcagatgccgccattgcagatgcgattccgacttctgcctgacatccaccgactgctccggcgacagttgcattgcgcatagcaagataaccaatcgcgctggcattataaagtccctgcttgatctgttcatcggaaagattataggtttcctggagggcaagcagaagtcccggaacgataccggcagatccggcagtcggggaagctacgatcacacccatggaagcattggtttccagagttgccatcgcgtaaatgacagctctttccagaagatctccgcaaagaccttttccggtatctttgtgatctgaaatcttttttgcttcgccaccgatcagtccacccatggatttgaccggggtatggatcggagtagaagcggctgatttcatgatctcaagaacacgatccattttgcggtctgtctcttccggatcctgttctccctctgtgagctctctctgaagcatcacagcagaaattgaaaggccttgttcctgacagacttttaataattcttttgcatttctaaaatccataatctgtattctccttccaattacatctgaacaaccataacgttgtatacatttttgtttcttctgattgtatctgcgatatcttccggtaccagatcatcggattctacgatggtataagcggtatttcctttggattcgcggaacagacgcatgaatgcgatattgattccaagttcactgaggcatttggtaatgtaagcaacaacgcccggtgcatctttctggacgacgacgatcgagctgtattctccggtaaaatcaacctccacaccattgatccggcacaggcgggcttttccgccaccgagagattctccgcggatcatcatctcctgcccttcttcatttaccatcaggatatcgacggtattcgggtgtacgtcggtttctacgttgttcggaatgaaagaatattcgattccgttgtctgtcgcgatctggaaggaatcgcggatgcgcacgtcatcggtggcaaatcccataataccgccgagaagagcacggtccgtaccatgaccgtgataggttttggcaaaagatccataaagggtaaattctacttttttaagagaaccggtgagaagctttcttgcaagcagagcgattctggcagctcccgcagtatgggagcttgatggtccgatcatattcggtcccatgacatcaaaaacactgataaaggacatagtaaacctcctgtaaaataattgttttacgtaagtaaaaaggattgacgtcttattagttatattgtaccatcaacttatgagtgaaacaaattcatagattttatgaagacgttgaaaatttttcataatggagtcagaagatggaattacgtcaattacagacttttacacagatcgcgcagatgcagagcttttccagaacggcagagatgctggggtattcgcagtcggcagtgacggttcagatccgccagctggaaaacgaacttgggaaaaggctgttcgacaggacaggaaagaaagtggtgcttaccccgcagggggaagaatttctggagcatgccaaccggattctttatgatgttcatcaggcgaaagcatccatgaatgatacggatgaattgaaaaatccacttcacattgggacgatcgagtctctgtgtacggtgaaatttccaaagatcataaggaaattcagggaacagtatcccagggtttctatccggattacggtagattctccggaaaagctgatccagatgatggaacataatgaactggatctgatctatattctggatacaccaagatgggacagcaactggatcaaggtgatggagaaggcagaaccggttatgtttgtgacatcagtcagtcaccggctggcaaaagaaagaaatttattgcttgatgatctgctgaaagagtctttttatcttacagagcgcaatgccaattacaggcaggcacttgatggtcagctggcgttaagaagaaaagagctttctccgatgctggagatcagtgatactgcatttatcaaaaaaatgctgatgcgtgggggaggcgtttcattcctgccacgttttgcagtggaagatgatattgagaaaaagaaactcacacttttggatgtgaaagatatagaaattacgatgtatcgtcagattttctatcataaaaataagttcaagacaaaagagatggagaaatttgcagagtttgcactggaggacaactaagagaaaatacggctatggataagaaaaatactgattttggcttggatgtattacgaaaatttatctgaagagcagggagagcataatattttctacgtcatcttgcgaagtctcaaaaaaggatttatactaaaaattaacagaaaatcataagaggaaagaaggaaataaaagatggaaaatttcacattttatgcaccgacttattttgcttttggtaaggatacagaaaatgataccggaaagtatgtaaaacgttttggcggcagtcgtgtactgctccattatggcggaggttctgtcattcgttccggacttttggatcgtgttaagaaatctctggacggagaaggggtttcttatgtagaattaggcggcgtaaagccaaatccgagaagtggtcttgtatatgaaggaatcgatctgtgccggaaagaaaaagtagattttgtactggcagtcggaggcggaagtacaattgattccgcaaaggcaattgcggcaggtgcagtatacgatggagatttctgggattattatgaaggaaagcttgtcgaggaagcacttccgatcggaacagttattacgatttcagctgcaggaagtgaaggatcaccggactctgttattacaaaagaagaaggaatgttcaaaagaggggcaaccggagaagcattccgtccgaaattcacgatcatgaacccggcacttacacagacacttccggcatatcagacagcttgcggaattacagatattatggcacatctgtatgagcgttatctgaccaataccgaagaagtagaagtgacagaccgtatgatcgaagggcttcttctgacgatgatccatgaaggaccgagagtcattgcagacccggataattatcaggcaagagcaaacattatgtgggcaggtatgatggcacacaataattcctgcggagtaggacgtacacaggactggacaagccataacatcgagcacgaattatctgcattgtatgactgcgcgcacggtgcagggcttgcggttgttatgccggctgtatttacttatacactggaacacaatgtgatgcgttttgcacaggctgcagtccgtgtctggggctgtcagatggattttgcagatccaaagagaacggcactggaaggaattgaggcacttcgaaactttttaatttcgattgggatgccaaagaattttgcagagcttggagccaaagaagaagatattgaaaagctggcacatacctgctgttatggagatgtaaatactggtacagtggaaggatttgcaactcttgatcagaaagatgtggaaaatatttataaactgatggtattttagaaaaagaaatatcggaaaacaggaaatttggaagagggagtgtgtgacttaaactcaagtcatacactccctctttttgaaacgtctattttccaacaggctatgcattttcataaatcggttcgaaatcatctgcgccgtgtccacagagcgggcaggtgaattcttccggaagattgcttccttcgtatacataattgcagatcttacagcgccatccgataatcttcttatcctcttttttctgttctggttttggctttacatgtgcctgataatctgcgtaagtcagaggcggattgttacttaaaagtttcgcatcggttacttcagcaataaaaagggtatgtgttccaagatcctgtctggaaactacttttgcgctgagaacagaacaagtctgccatccgaggtaaggaactgcattttcatctgcaggtgcagtgatatttgcgaatttatcaacatctctgccggactggaaaccgaaatgccggatcgtttcaaaagagcaggtctggtcaagcaggcttaacgtaaaaatgccgctctctttgatcagatcacaggtatagttgctattcagcacagagattgcgatccgtaccggattattcgcaacctggatgcaggtgttggtaatacatccgtttactacattcccagagcgtgttgcaagcataaatactccataagataaattgtaaagtgcttttttatccatataacattcctcctaactttcaaaacttgataataagaatcattactataattaaagaatacatgataaaagaaaaattgtcaattataaaatcaagatttccggaaaatcagaatcacaaaaaatgtgatgatttctgatcctaagaaggaaagccagattccattcagccccagaatctgtgagaacagaatcgcacagaaagcaattgcgataatgccgcgcataacagaaccaaggacggcaggacgtgcccggtcgattgcggaaaaataggcaaccagcacaatattgataccggcgactaaaaagcccaggaaataaagcctaagaccagtatgggcgtaagcaagcagctggagattatgttcgctgttaaagatactgataaaggtatccgtaaatccgtagatcagtacaacgatcacaagctcgatcagaagtgctgcagcaagagaccagttgagaaatttacggactagatcatgttcaccctttccgtaactctggctgatcagcggctgtgcaccctgggcaagtccgtttaggatcgccattgcgaccagtgaaatatttgcaactacgccgtaggctgcgatcccgatatttcccgcaatgcgcaggatcagcatgttaaatataatcgtaatgacagcggaagaaatttcagcaaaaaatgcagaaacaccaagctggcagcatccgatgatccggcgaagagagggcttgcgccagtgaaactctacatggttattctttccaagataatgtgtcgaacataccagcatcgtcacaaccggtgaaagagcggttgcaagtgcagctcccagaaatccaagattcaaagggaacatgaaaatatagtcaaataaaatattaaagaagcttccggaaatggaaccgatcatggcgatagaggtcgcatggtcattcctcgcaaatgccgtgaaggtatagtttgacataaaaaacggggtaaagagcaggacgatacgcatataattacgtccaagccggatgagcccggcatctgcccctaaaagtgcaagtgctttatgcggaatgaagattccggtgagcataaaaggaatgctgcatatgagacaccagaagatggactgggtaaaatagtagttcgaaggtgaaccttgggctgtgctgatattgtatcgtgtggcggagccgattccgatcatcgaaccgattgcgaagaccagaccgaacaccggcaggatcagattcagggcagcaagtccatctgcaccgcatttgtaagagataaaaaaggtatctgccagaatgtagacggagacaccgatcattccggaaatactctgggaaatgtattttaaaaatttatgaaacatgtttttgaattcctcgtctttcttaaagtcagattaaatgaaataaccatctgtaccagcctggtaataagcggactctgatatctccatataagaatagcataaacatactggtttgtcgaaaaaataatcttgcaattattgcggtaacgtgctatagtaagttttgtaaaaccaaataatgcttcagggcggggcgaaattccccaccggcggtaaagcccgcgagccgtaaggcatgaactggtgagattccagtgccgacagtaaagtctggatggaagaagttgaatcgttgctgatagaagcggtttctatcatatatgcaggaataaaaagtaaaacgctctggaatgggaatcattccagagtttttattttccggaaaataaaatgccgaggccagattcgatgagaaaatggtatttccgagaagtatgacagagcgtacagcgatataactgagaaagaaagccctgacaggtaagagaatctgtcagggcttttcctatatgccaaagcacattttttgaaaagagacttatccggcaacatacctaaaatgtttagcagagtacatttccagggggcttttccgggagagatgagaaaggagaaaaaatgacagatgaattttacatgcgccgtgcaattgaactggcaaaaaaaggacgtggatggacaaatccaaacccgatggttggtgccgtgatcgtaaagaatggaagcattatcggggaagggtatcacgaaaaatgtggtgagcttcatgcagaacggaacgcaatcgcatccctgacagaaagcgccgagggagcaacactttatgtgacgctggagccgtgctgccattatgggaagacaccaccatgtacggaagcgattctggaacagaagattgcacgggttgtgatcggatcgagagatccgaatccgaaagtgtccggcaaaggagcaaagattttacgcgaggcaggcgtccgggtggaagaggatttcctgcgcgaagaatgtgatgcgttaaatccggtctttttccactatatcacaacagggctgccctatgtggtgatgaaatacgcaatgacggcagacggaaagattgcgacaaaaacaggagcatcaaaatggatatccggtgaggaagcaagaagtctggtacatgagatgcgccatgactatatggcaatcatggcaggaatcggaacggttctggcagatgatccgatgctgaatgtgcgtctggagggaaagaaaagtccggtcagaattatctgtgacagtatgctcaggatcccactggacagtcagatctgccagacagcagggagataccggacgattgttgcatatgccggtgaaaaggggaatgcgatttatttagaagagaaaaaacgcagtctggaaaagcttggagtcgtgcttctcagagttccttcggaaaaaggggagatcaatctgcagcttctgatgagaaagcttggagagctgggaattgacagtgtacttattgaaggcggtggaactttaaatgaggatgccctgcaatccggtatcgtaaatgaggtgaaagcttttatcgcaccgaaaatttttggcggaagaggcggcaagactccggtggaaggctttggaattgagaaagtagacgatgccatcaagctacagcttatgagaatctcgcaggttggagaagatattctggcagagtataaggttttggaggaaatgtaaatgtttacaggaattgtagaagaaaccggatctatccggtcactccgactttctggatcatccgggaagattgcgatccgggcaaaaaaagtactcggtggaaccaggatcggagacagtattgcggtaaatggtgtctgcctgacggtggtttctctggaaaaggatggatttaccgcagatgtgatggcggaaacagtgagaagaaccaatcttggtgatacgaagattggtgagaaagtgaatctggaacgcgcgatggcggcagatggcagattcggtggacatatcgttgcagggcatattgatgggaccggaatgattgaagaactcagaaaggaagaaaatgcggtatgggtaaaaatccggacaacgccggagattctggaactgatcgtagaaaaaggttcaatctgtattgacgggatcagtctgacagtggcagaagtaagtgaaaaaagctttcaggtatcagtcattcctcataccggagaggaaaccacactgctgaagaaaaaagctggggacagggtgaatctggaaaatgatattgtagggaagtatattaaaaagtttcttacaccatcggaaccggctggaaaatgtggtggacttaccatggaattattagaggagtatggaatttgatgcgaagaaattccgggaccggaatggagagcatacagaagaacaggataaaaatgagttatagatcggacaggaggaagtaacaaatggagaaacagtatcaatacaatagcgtagaagaggcacttgaagaattgcgccagggaaggatcgttctggtaacggatgatccggaccgggaaaatgaaggagatatgatctgcgcggcggaatttgcaactcaggagaatatcaattttatggcatgccatgcgaaagggctgatctgcacaccgatgagtgcagcgctggccggacggcttgggctttcacagatggtctccgaaaatacagataaccattcgactgcatttacggtatccgttgaccatgtggatacgacaacgggaatttcagcagcagagcgaggatatactatgcgcagcctgacagaagaaggaacgaaaccgcaggaccttcggagaccggggcatgtatttccgctggtggcaaggcatggaggtgtgttggtaagaaatggtcataccgaggcaacggttgatctgatgcgtcttgccggactgaaagaatgtggaatctgctgtgaaatcatggaagaggacggaacgatgatgcggacagagaatctctggaagctggcgaagaagtacgacctgaaatttattacgatcaaaaatctgcaggattactgcaggatccatgaaaaacatgtcgtaagggaagcatgtgcaaagatgccaacccagtatggagaatttcagatttatgggtatgtgaatgacatcaccggtgaacatcatgtggcattggtgaaaggtgagattggcgatggggaagatgttctgtgccgtgtacattccgagtgcctgaccggcgatacttttggatctctccgctgcgattgtggaaagcagctgcagtcggcgatgcagcagatcgagagagaaggaagaggagttcttctgtatatgcgacaggagggaaggggaatcggtctgatcaacaagctgaaagcgtatgaacttcaggaacagggatacgataccgtggaagccaacatccgtctgggatttgcaccggatcttagggaatactgggtaggggctcagattctatcggatctgggagtaaaatcactccggcttcttacaaataatccggagaaggtatatggactttccggtttcgggcttgcaatccatgagagagtaccgattgaaatagcaccgcagaaatttgatgcattttatatgaagacgaagcaggaaaagatgggacatatctttaaagaaatcaaatttcagtaaaaagagaataaacagtatttatcatagaagaaacactttaattacaggaggaaaaaaacatgagacagatcaatgtattagaaggaaaagtagtagcaccagaaggaatgaaagtaggaattgttgcttcaagatttaatgagattattgttaataaactacttggtggtgcggtagacgggctggtacgccatggcgtggaggatgaaaacataacggcagcatgggtaccgggagcatttgagattccgacagcagcttctaaaatggcggcatccggaaagtatgatgcggtgatctgtgtgggagcagtgatccgtggagacacgacgcattatgattatgtctgcaatgaggtatccaaagggatcgcacaggtcggacttgcaaccggagtgccggtattatttggtgtgatcacgactgaaaatatcgagcaggcaatttcaagagcaggaagtaaaggcggaaataagggatatgactgtgcactttctgcaatcgaaatggtaaatcttctgagacagatgtaatttccggctgacggttacaaaaagaatcctgttttccggcagaaaaagggcagatgccgggatttactggacatttatgcaggaaaaaggtatcatatctgataagagaaatctgtaaaagaaatagtaaagtttcaattcagagataatgaaggagaaaatgaattatgtatacagcatcatctgagagatatgataccatggtatataaccgttgtgggaaaagcgggcttttgctgccggcagtttctttaggactttggcacaattttggaaccaatgcggatccggagaatatgaaggcaatgttgaggacagcatttgatctgggaatcacccatttcgatcttgcgaataactatggaccggaatacggaagtgctgagacgaattttgggaagattttaaaagaagactttgcaccatacagggacgagatgatcatcagtaccaaggctggctatgatatgtggccgggaccttacgggaactggggaagcaggaagtatctgatcgcaagccttgaccagagcctgaagagaatggggatggattatgtagatatcttctatcatcacagaatggatccgaataccccactggaagaaaccatgggagcactcgattccatcgtaaagagtgggaaggcactttatgtcggaatttctaactatgatggtccgacaatggtacgtgcagcggagattctggaagatctgaaatgtccgtttgtcattaaccagaaccggtattccatttttgaccggacgattgaacagaacggcttgaaaaagacggcgaaccagatgggaaaaggaatcattgcatttagtccgctggcacaggggcttctgacagataaatatctgcacggaataccgtcagacagccggattgctgtggatggaaggtttctacatgccgatgcattgacgaaagaaaagcttgcgcagatcgaggctctgaacaagatggcaggtgagagaggacagtctcttgcacagatggcactgagctggatcctgaaagatgaggatgtgaccagtgtgctgatcggagcgtccagaccggagcagatcattcagaatgtggagattgtgcagaatacgaagttcacccgggaagaactgaaaaagatcgatcagatcagcaggggcaatctgtaagtgaaacctgtgcgaagaaattatttgcaaaggacgcaaaggaaatattgaataaatgattgacaggaagcagccattgtgttattatagtccatggttgcttcagcaatcaacaatttcatataggggattggtcaaatggtatgacaggagtctccaaaactcttagcggcagttcgattctgtcatcccctgtaacttgaaggactcagtttgagtcctttttttatctaatggaccaagtgcggaatggtgatagcgcaagtccaaatcaactcttcatttccaaaacaaaataatcatcccgctagatatatatattcgacatagtcactatacatagtgcataaaaataaaagaaaataattgtaaaaaatgccaaaaattcaactgcacaaaagcacaaaatccgtcaaaaaagaatctcgaatgctacaaactaaaaaaagtgtcaaaaaatagaagtaaaaacagctaaagaaaataaaagaaaaacagatgaagatagtgaaaatagataaaaaaattggtttttttactgtacaatctacaaaagctgaaaatattgacaaagaaaaagtgtgagcgtaatataagcatgacttttagaggacgctctgaaaagtactataaaataagaataaataaaacgaaagggagggagcgataccaatgtcattaagttaatttaaaaattaaaaaaagcagaatgcaagtaggtaaaatctcacttgtattttgcttttttcattttgttatctgtttttttgcacggcaaacagacagatggattgtacatctgtctataatcctatataatgatgaatggttatgctaccctgtatagaaaacttactgacgcctgatgtttgactttccgagggtctcgacgcccaggtcttattggtaatatatgtttttctatcagtttaaccacatcaggtggacgaagtttccgtttgcgtcgcagatattctctgcaaatgtaaatggcaatagtaaagttcacctgatttttcttacttatattttctgtgtgttcaactacatatgttgtaattaattcgcagtaattatataaggtcaatcttgcaaatatttcttgctttatgtaatccacttttttggcatgaaaactagttagccctatagcatatttcaattcacgaaatgatgtttctatgccccatcttaagtgatataattccttaagtttttctgccgaaaagcaaaaacggtccaagtttgtaattaccgtttcataggaatcatctgctattttaaaccttgcaattctaaaggagataggataatcctctttgcttcctattggaagataatcaaaggtttgtactgttggcatgaatttatatcctgcttgtttctttgacttagtttgatttcgtgtcagaatcagattgatatccatatcaaaaactgccgtttgtggaagttctaagcctgatgcaatgccattgctgtgaacatcttttattctaatcaaaaatttccagcctttttctattgcgtgagacataatgttatagttttcatatcctctatcagcaattaatataactttgtccaatgtcaccctttctatcatttgaatgcatgctctgtgttcttgatacgtagaggcagtttgaaccaatgcatcaatataagttctgtttaaaacatcatacagggcatttagatgtaagtgattaccggttgcaccaagttgatttgatttccaaagagtttccgggtcgtttagattcggtgcaatagttagattgctgccatcgcaagccaaaagttgatatccctcatataagttttttgtttgagcattttcttctgtaaacgcatgaaataagtattcaaatgcttctggtagaattttagcccgctgctgtgtatacgctgaaacagtaggagcattcacatcaaaatcgaaaaaatccaagagttctttattcagcgtgcaaccgccggaattcatggtaatgccaacacatgtcttaaaattaattttgcggtttcttgaaaaatcagtatctggatttttcaagaacaaagatggatttcttgccaattctgaaattagattttctagtgaaaccgtaaccttttcaatatagtgactcataatgtatcctccttgcaatcaagatattccttaattacaagggccgctttcgcaaccttaatatatatcggtagcgaaagcggccgcacattctatcttgtttgtcaactatttttacaaaataaaaagactcctatattatttctaatataagaatctaattatttttccttaacttaatgacattgggagcgatacggaacatttaacagagactctgttagaagagctgaactgcgagacagtgtttacgatcccgatattcggcggaataccggtaaaagagtcggtcgtagttacctggatcatcatggcggtaatcgtaggactttgtatcatatttgtccgaagcttgagcgtcgaaaatccgggaaaggttcagcttttattggaatccgcaataggaaaaggactggacttctttgaagacatcatgggaaaagaaaacaggaaatatattccgtatctgattacagtgcttatctatattgggatagccaatatcattggtctgttcggatttaagtcacagacaaaagacctcaatgtaacagcagcacttgcgatcatgagtatgtgcctgattgaattttccggaatccggaagaatggatttaagcactgggcggcgcattttgcaaagccggtaccattcgtagcaccaattatggttctggagattgtgatcagaccattatcactttgcatgcgtctgttcggtaatgtattgggagcgtttgttatcatggagcttttaaaagcagtggctccggttcttatcccgataccatttagtttttacttcgatattttcgatggattcctgcaggcatatgtattcgtattcctgacagcacttttcatgaatgaggagcaggaataatcccgaaatgacagaagaaacacaaatctataagaaaaaaggagattaagattatgttagtagcaattggagcagcagtagcagttttaacaggtttaggagcaggacttggaatcagccttgcaacaggtaaagcagtagacgcgatcgcaagacagccggaagcagaaagcaagatcagcaagaacctgatcctgggttgtgcacttgcagaggcaaccgctatttacggtttcattatcggacttcttatcatcttaatgctgaaataagaaaagtaaaatgaagaaaggcaggtgggacaggtgatacagtttaatgtaagccttctctttacgatcatcaacctgattgtcttttatcttttgctgaaaaaattcttattcaaaccagtaatgggaattatggaaaaacgtgaaaaaatgattgctgacggactgaaaaatgccagtgatagtcaggaagaagcggcgagactgaaagcggaatatgaaaaggctctggaaggagcaaaggcagaatccattcagatcgtggaaaaagctaagaaaactgcagccggagaatcagagcgtatccttcaggaagccaatacggaagccgtaggaatcctgaaagatgccagaaagacgattgaaaatgaacgcaaacagaccatgaatgatctgcaaagtgagatcgcaggactggcaatgcaggcagcacgtaagattgtggatgacacaaaaggaaatcaggatatatatgatcagtttctgaaaggtgcaggtgatgctcatgtcaataaagaggttaaataaagagtattgctgtagcccttcggcaaaacagtatgcacatgttttatatgagcttggaatttcaaaagaagcggtaggagagactgaaaagctttttgaagaagtaccggtgcttgaagaaacatttgcaagtccggtggtaccgatgcgggaaaaattaagttcgatcgacaagattttcccggaagaaataaaaaactttctcaaggttgtatgccgtaatcagagaatgagcgagatcagtcagattctttttgcttatgacagatactgtaaaatgcatgaaggaatccagatggcaacgcttacctgtgtggaagcaccagatgaaaagcggcttgagaaaatcagagaatttctttgtgagaagtaccataagacagatgtgaagatcgagatagtcaaagatccggcattacttggtggatttatcttaaagaccggtgatgatgaatatgactggagtctgaaaggaagattatcgagattagagcaaaaattgacctggaggtgaacaaagtgagttcaattagctcagatgaaattatttctattctgaaaaatgaaatagagaactttgatcagatcagtaaagacagcgaggtcggtacggttgtctctgtcggtgacggaattgcaaatatctatggaatagagcatgcaatgtacggagaaatcgtgacatttgaaaatggactgaaaggtatggttcaggacattcagaaagatacgatcggctgcatcctgttcggatcagatgtagagatcaaagaaggtacgaaagtgatgcgtaccaaaaagaaagccggagtaccggttggcgataaatttatcggacgtgtcgtaaatgcacttggagctccgattgacggagcgggagaaatcgaagcagaagattacagaccgattgaaaatgaagcaccaggaattgtagaccgtaaatccgtcagcgttccaatggaaacaggaatcctttctatcgattctatgttcccgatcggacgtggacagagagagttgatcattggagaccgtcagacaggaaagacttccattgctacagacacgattttgaatcagaagggtaaggatgtcatctgtatctatgtagcaatcggtcagaaagcatcaacgatcgcaaaggttgtcaatacttttaaaaacggcggcgcaatggattacaccatcgtagtagcatcaacagcaagtgactgtgcaccgcttcagtatattgcaccatatgcaggaaccgcgattgcagaacatttcatgcataaaggaaaagatgtcctgatcgtttacgatgatctttcaaagcacgcagttgcataccgtgcgctgtccctgcttcttggacgttcaccgggacgtgaagcttatcctggagatgttttctatctgcattcaagactgcttgagagatcaagccgtttaagcgatgaaatgggaggcggttcgatcacagcacttccaatcatcgagacacaggcaggagatgtatctgcatacattccgaccaacgtcatttccattacagatggacagatcttcctggaaagtgatctgttcttctcaggaatgagaccggcggttaacgtaggtctttccgtatcccgtgttggtggtgcagcacagacaaaggcaatgaagaaggcagccggaagtatccgtatcgatcttgcacagtatcgtgagatggaagtattcacacagttcagttccgatctggatgcagcaacaaaggaacagctggaatatggatctggtctgatggaacttctgaaacagccactcggacatccaatgtccatgcatgagatggttatcaccctctgcgcagcacgaaataaagtgcttctgggaattccggtaaaagaggttaagaaattccagatggatatgctgaattattttgcaacagttcatccggaaatcagtgaagagattgagcagacaaaggctctgtccgatgaactggctgcaaagattgtggaaacagcgaaggaattcaaagacagcaggtgttaatatggcaaatatcagagaaatacagactcgaatcaacagcgtcaaagatacgatgaagatcacgaacgccatgtatatgatctcgtctaccaagatgagacaggcgaagaaaaagctgacagattcagagccgtacttttacggacttcagggagagatttccagaatcctgaggcatattcctgagatcgagcaccggtattttgatgtgcgggaagagattccaaaagagaaacgaaagataggttccattgtcattactgcggataaaggacttgcaggagcttacaaccacaacattgtcaaggtggaggatgagatcctggaggaaccgggagagcataagctgttcgtagtcggtgagcttggcagacactattatgcgaataagggtgtggaaattgacaccaatttcctttatactgtgcagaaaccgaccatgcacagggcaagagatatcgcggaagtgattctttcccagtatgagagaggtgaactggacgaggtctacatcgtttacaccagaatggaaaattcgatgctgacaacggttgaaaaaatgaagatcctgccgcttgagagatcttcatttaatgaaatgaaaatgccgcttaacatccatagagaggcgatcgcgctttatccatcagcagaggctgttctggacagcatcgtaccaaactacgtggttggtatgatctatggatgtctggtagaggcatatgcaagcgaacacaatgcgcgaatgacagcaatgcaatcagcaacagacagcgcgcaggaaatcatcaaagatctttctattatatataacagggcaaggcaggctgcgatcacacaggaaattactgaggtttgtgcaggtgccaaagcccagaaacggaaaaggaagtgaaaacaggtatgaataaaggacgtattgtacaggtcatgggaccagttgttgacgttgtatttgaagacggaaatctgccgtgcatcaaagatgccctgcaggtggagaacaacggaaaaacctgtattatggaagttgcgcagcatctgggaaatgatgaggttcgttgtctgatgctggcagcaagtgaaggactttgcaaggacatggaagtaaccgctaccggttctggaattaaagtaccggttggagagcagacccttggacgtctgttcaacgtacttggagaaaccatcgacaatggcgaagaaatcaaagaagataccgaacactgggtgatccacagagatccgccgtcatttgaagaccagagcccggttgtagaaatcctggaaaccggaatcaaggttatcgacctgcttgcaccttatgcaaaaggtggtaagatcggtctgttcggcggtgccggtgtaggtaagactgtactgatccaggaactgatccgtaacgtagccacagagcacggcggatattccatctttaccggtgttggagaacgttcccgtgaaggtaacgacctctggacagaaatgaaagcatccggagttctggataagacagccttagtgtttggtcagatgaacgaaccacctggagcacgtatgcgtgtcgctgagacaggacttacaatggctgaatatttccgtgataaagaacatcagaatgtgcttcttttcattgataatattttccgttttacacaggcaggttccgaagtatccgcacttcttggacgtatgccatcagccgtaggttatcagccgacactggcaactgaaatgggtgaactgcaggagaggatcgcatctacaaagaatggttctgtcacatccgtacaggctgtttatgtccctgctgatgaccttacagacccggcaccggcaactacatttgctcatctggatgcaacaaccgtactctcccgtaaggttgtagaacagggtatttacccggcagttgatccactggaatctaactcccgtattctggaggcggatattgtcggagaagaacattatgaagttgcaaaccgtgtaacagaggttctgcagaaatacaaagagctgcaggatatcatcgcaattcttggtatggaagagctttccgatgaagacaaggcaacggttatgagagcaagaaagattcagaaattcctctcccagccattcttcgttgcagagacatttaccggagttccgggaaaatatgtacctctgaaagagacgatccgaggatttaagatgatcctcgacggagaaatggatgagtatccggagaatgcattcttcaatgtaggaacgattgatgaagtcatcgagaaggcaaaggctgaaaaagcagaatagaggtgccaggtatggatacatttggacttaaaatcatttccagtgaccgggtattctatgaaggacgttgcagaaagatgatcgtgccggtaccggacggcggtggaatggaaattcttccgcaccatgaagatatggtgatcgctgtggtgatcggtgaggcaatgcttcagtttgaagaaggcgaatgggtgaaccttgcggtcggagccggattccttgagatcgtcaacaaccgtgtgacgatgctggtgcagacggcagagaaaccggaggatatcgatgccagacatgcccaggagcagatggagtatgcagaagaaaagcttcgccagaaacagagtatacaggaatattaccggacacaggcttcgctttcaagggcgatgaaccggttgaaggtgtcgaagcgaaaaaaatggtaaataggaaacaaatttatgtggaagcgcgtaatctactacagattgcgcgctttttcaatacggaatttttgacaaaatttattgggaaaaatggtacaatcttttacaaaataaaagttccgatacagggtagtttgtggtagaatatataacagtgtgcgtgtactgagaaaaaggattttgaggtgttcaaatagagtgtatttcatcatagaaggagcaaaaacgtggaaaaagaggagcttacgcaattatttaatttctttcgggagattgataaggaaaaatttattggaaggcagacatatctgacggatggggtgcgtaaggagaatgacgcggagcatgcgtggcatatggcaatcatgacggttctgcttgcgggatatgccgatgagaagatcgatgttcttaagacagtgacgatgcttttgatccatgatattgtagaaattgatgcgggggatacctatgcctatgatgaagatgcgaagaagacgcagagggaacgggaagtgaaggctgcggaccggattttcggacttcttccggaaaagcagggaaaggaatttcgggcgctctgggaggaatttgaggcacaggagactgctgagtcgaagtttgcccggacgatggacaatatccagccgatcatgttaaatgcggctacagacggcaaagcgtgggaggaacacgatgttcatattgaacagatcctgaaccgtaaccggaatacggcaaaaggctcagaagcgatctgggagtatgcgaaagaagaattcttaagaccgaatctggaaaatggcaagataaaaaaataacataaaaaaaacaaaaataccccttttcattttcgtgaatatggggtatcatatactacagagcgcaaaatatagtggagaaacttaaaagtgacactatattttgtggagcgatggaacaaagttaggagaaagttgggatggatttggaagtaaagacgagagtaatcaaaagaaacggtgaggaagtagacttccagctggagaagattgtgaatgcgatcaaaaaagcgaatgaagaggttgagaacatccacaggatgaatgactttcagatcattgcaattgcggagaagattgcacagcaggcagaggaatttacgcatgcagtgaatgtggaggacatccaggatatggttgagaccggcattatggagatgcgtggttatgaggttgcccagaagtatgtccgctatcgctataagagagaattaaccagaaagtcgaatacaacggataacggaattcttgcattgatcgatcatatgaacgaggaagtaaagcaggagaactccaataagaatcctgtgatcaactctacacagagagattacatggcaggagaggtcagcaaggaccttaccaagagagtccttcttccggaggaaatcgtccgtgcacacgaagaaggaatcattcattttcatgatatggactattttgcacagaaagagcacaactgtgatctgatcaacctggaggatatgctccagaatggaactgtcatcagcgagacgatgatcgagaaaccacatagtttttttaccgcgtgtaatgtgaccacacagatcgttgcacaggttgcaagtaaccagtatggcggacagtcatttacgctgtcacatcttgcaccattcgtagatgtaagccgtcagaagctccgcaagagtgtcattgaagaaagaatagaatccggagaggttctggatgatgcgatcatcgacaagatcacagagagaaggcttcgtaccgaagtacagagcggaatccagacgatccagtatcagctgatcacactgatgacctgtaacggacaggcacctttcgtaacggtgtttatgtatctggatgaggtcccggaaggaagaaccagggatgaccttgcgatgatcatcgaagaagtgatgaagcagcgtatgcagggtgttaagaatgaaaagggtgtatggatcacaccggcgttcccgaagctgatctatgtactggatgaagataatattaccgaggattccaaatactggtatctgactgagctggctgcaaaatgtacggcaaagcgtatggtgccggattatatttctgcaaagatcatgaaagaactgaaaaacggagatgtttatccgtgcatggggtgccgctcattccttaccgtagaagattcccagagaaatgcagacggaagtcataagttctatggacgtttcaatcagggggttgtaacgatcaacctggttgacgtggcatgttcagcagagggcaatatggaacgtttctgggaaatcctggatgagagactggagctttgtcacagagcactccggtgcagacatgaacgccttctcggaaccgtttcagatgttgcaccgatcctgtggcagaacggggcacttgcccgtctgaaaaagggtgagacgattgataagctgttatttgacggatattccaccatttctcttggctatgcaggactttatgagatgtgtatgcggatgcttggcaaatcccatacagatccggaggcgaagccatttgcactggcagttatgcagcgcctgaatgataaatgtaaagaatggaaagaagcagaaaatatcagctattccgtatatggcacaccgatggaatctaccacatacaagtttgcaaaatgtctgcagaagcgtttcggaatcattccgggcgtcacagataagaactatattacgaacagctatcatgtacatgttactgaagagatcgatgcattcagtaagctgaaatttgaatcggaatttcagaagctttcaccgggtggggcgatcagctatatcgaagtaccgaatatgcagaccaatattccggcggtactttccgtattacagtacatttatgagaatatcatgtatgcagagctgaataccaagagtgatttctgtgaagtctgcggttatgacggagagattaagatcatcgaggacgagaccggaaagctggtatgggaatgcccgaactgtggcaaccgggatcaggataagctctttgtagcgagaagaacctgtggatatatcggaacccagttctggaatcagggaaggacccaggagattaaggacagggtactgcatctgtaaggatggaaatgtttttgaaaaaatagtgagaagatataataaaggacacggctttcgcttggcgaagccgtgtcctttattataaattatttaaaattaattggataaacgtcttttatcaaaccatcctggtcataagaaaaatagattttttcgaccatttcttctttattgatcttaaaagtcacaagaactgtttcagaatcatctgttttggagtcaagcgaaatatcttttacagctatttgggtattattaacagctgcctctgacagataggtctgaccataggttgaaacaaaatattctaattggtcgcgctcaaaatattttcctacaagcttgttccagttctcaagaattttctcagaattggcgaaagcatcatcagaatttgcatcagtattttcaccgattacattagaagcatccggagagtataattcttcatttggcgcagtaaacattgcagtaattactgcttcggcttccggacttacggctgattcagatgcctttttgtctgagcagccagtaagcagaataaacaaaagtaacagaataaaataaatttttggcgttgcttttttcgtcatgagaatccctcctttgcttgtgggggcagttaaaatagttttcctgccattggattgatctgcctttcacattttgggtgtttataagtatagtataatggagctggctgtaaaacgctaatattatttttacaaaaaggcagttgcttgggcgaatgtatgcggacaaatcatagcagcacttatcacagcatttggaggagtcaaaagaccgccggagcggttggaatcgtactttatcggaggacaatagtagttgattttcaggtgcgatttgctataattgataagaagagtaagaatggacagcagagtagtactgctataatgagaaaaagggaagtataaagatatgaattacggaacaatcaaaaattacgatatcgcaaatggaaccggcgtcagggtcagccttttcgtatccggctgccggcatcattgcaaaggatgcttcaattccgagacctgggatttcaattacggcaatccatataccaaagaagtagaagcagagatcctcgaagcacttaaaccggcatatatccagggattttccctcctaggcggcgaacccttcgaaccggagaaccagaaagagctcgcaggactcctgcaaaagatcaaagaaagctacccggagaaaaatgtctggtgctacaccggatatctctatgatgtagacctcatccccggcggaaaagtctacaccgaatacactgacaagatgctcgcctgtatcgataccctcgtagacggcgagttcatcgaagccgaaaaagatctcaccctggaattccgcggaagccgcaaccagagaatccttcaccttgatgaaatccgccaaaatgcgaaaaactaaaataattcattgacaaaaaaagaccactgtgatataaataacaagtggtcttttttagatcataaaattaaataggggattggtcaaatggtatgacaggagtctccaaaactcttagcggcagttcgattctgtcatcccctgtagaaacctctcggaagtagttccgggagattttttatattctataattcccaccagattcaattgtttgcacaaagaatctggtgggaattatttttgtctgatgttgacacaacctatatttttgtaaatcaatatatttctttagaaattaaaataaagttcgtataccttaaccggccgccccttcgcattggtcgtctgcgtataagcgagcttcgcgactcctccattttccagattctgaataatccggttcgcatttctcaccgtacttcccatccgttcggcaagctcgtgcgttgtaatcttatttgatccggcagcatgcgtactggcaaggactttcttgatcgtaaccggtgaaagattacactgctttgcaatctttccaagattctgcacatactgattctggatcactcttcggtcggatgaaccaaggggtccgatcatatccccgttttcattctggataaaactttttccaaactgaacagcctctttgcgggcatttacagaattacggatcgcattgtcaaaatttgccccgattccgtatcctacagcacattcaaaatgcagtttgtcggtgagaaattcattcagttcgcagaccttgttattgtgtgtaatatgctgcagcatttccacagtggtcagggcactgcagtgattatccactttctgagagatacaattcatcagattctttttaaagaaatcttccatacagacatagatctgctggatattttccggtgtgttatctgtcgaactacggggagatacattgatgataaccggaaggttggaacgcatgtgctccagctcgatcgtggacagaagttcatttgcaagatcccggatatggctgacacttggcagcggatagattgtcgggatcccgtgcgcacgaagctccggcaggatattactgtactgacagagaaccatatccatttcattgttgttccacatacggatcagctctgaaaggacatgattttcaattgtactgatgctagtgcgggtcagtgccttggtccagttgttaatatgtggtggaactgtatcaatgtccagctccttaaggaaagcggttgcagtacagccgccatcgatcggaatcaggaaatccagaataatccggtccatatccagatcccggttggaaatcagcagattcaaaaaagcacggtacagaccggctatatcaatttcaaaggatacaatcggacggttataagcgtgcgcagttgactcaatggcagcttttgcgatcttaccactgataagaaatccgtcagtgtccccggcgtaagaatcgtaaacttctgatattgtgtcaaatttgttgtaggaaaccacctggatgtcgcagtttagttttagttctgagacgatctgcgagataggttcctttaagtactggctggtaatagccacaatttttcttctcattttctttcacctctcaaaaagtatcatataaaattatcttccataaatcaaccataatattctgaaaattaaaaaaataacgattaaataggtaaaaacaacgaaaatcaagaatattctgtaatattattgactaaaattttagaagttggtattatgtaatcgtgataactattctgtaaatgttccaaaaactaataaaaatattctgtaaatattctaaaagtagaacagtatttttaatgtaaatggcaggaacaaagttaaaggagggcttagtatgaattactatgaaagagcattggaattaaaggatgaaacaattgcaaaccgcagacacatccacaaaaatgctgaaactggtctggatcttccaaagaccaaagcttatgttatggaaaagctgacagaatacggacttgagccgaaggattgtggctacggggtaacagctacactcggcaaagggggaaaggttcttcttctgagagcagatatggatgcacttccgatgccggaagaaagcggagaagaatttgcatgtcctacaggaaaagaagcacatacatgcggacatgatttccacgccgcaatgcttcttacagcagcaaagatgctgaaagaaaaagaagatacactggaaggaactatcaaattcatgttccagccggcagaagagacttttgaaggaagcaagaatatgatcgagaatggtattcttgagaatcctccggttgatgcagcacttgcataccatgtatcaccgggaaaaatgccaatcggactttttatgtacaatgataaggatacgatgatgtattctgtagatggatttaagatcaccatccatggaaaaggatcccatggtgcttatccacatgtaggagttgacccgatcaacatcggagttcatatccatcttgcattgcaggaactgatcgcaagagaaagtgatccgacacattcctgtgtacttacaatcggacagtttgcaggcggaactgcagcaaacatcattcctgagaccgctgttctccagggaacgatccgtaccaataagccggaagcaagagaacttttggtccgcagaatgaaagaagtcgctgaaaagacagcagctgtatataacggaaccgttgatattgagatgatctcagaagttcctccgctgatctgcaatccgaagcttaccgacgaagtggttggatatatgcaggagcttggaattccgggactcacaccatatccgggaatttctgcaagtgcttctgaagatttcgcagtgatcgctgaaaaggttccaagtacatttatgtatctgtcagcaggatatctggatgaaagaggacagtatccggcacatcatccgaaagcacagtttaatgaagatgtttgcccgatcggagcagcttgtcttgcccattgcgcttcacagtggcttaaaaataacaaatagagagtaaaggtttctttaggaacaggaggaaaagaatatgagtaaagaacagcaggctcaggaacagccacaggttgcgattccgcttccgaaggcaaagaaaaacttggttcagatcggatgtatctgcatgatgctttccgtagcaatgtatggactggtatttgcaacgttaacagcacctatccttgaaaaagttgatgcgatgggatatgtaggactcttctctatcgtaggtgcgatcggtgtatcgattatgactccgatcggaggaaaattaggtgaccttattggtagaagaaacattgtagtgattcctggaattatctgtgcacttgcaggttttgcatttgcatttgtgagatctctgattccactgatgatcctcagactgattgtcagtcttgcacagggcgcatttacagcagcaccatacattatcgcaggtcttatcaatgaaagaaaagatgtaccaaaggcaatgggtatgcttgcaaccgcaatcgctgttggtggatttggaggaagtatcatcgcaggtattttaacagatatgggattattgactgtggcaatccttatgccggcaattccacttattcttggtatagtactgatcggaatgaacatgccgaatcagaaaagagaaggaaaggttacgattgatgttccgggaatgatcgcactcatcgtatcactttgcggaattctgcttgcactgaactttggatcttctatgggatggacaaatccaatgattcttgcaggtcttgtaattggtatcattgctcttattgcacttgttaagattgaaaataaagctgcagagccgttgattccaatgaaattatttaaaaataaaaactacacagtactccttattgtaggatttatctgctatttctatcagaatgccatgaactattatgcaccgatcggtgccatgcaggttatgggagcatccacgagtgcagcaggtgcactgcagatgcctcgtacactgattacaatcattcttcctactatcgcaggtgcatgggtaggaaagaaagctgccaatgcatggaaagcaatggtaattggtacaagtcttgcaatgatcccgatggctgtgatggcgttggtaacaaattcaggtgcttcgatcatgatttattttgtagcacttgcagttacaggtattgctgaaagcttccgtgctgtatccattacgccaacagcacaggcaatgctggcaccggaagatatgggaatcggaacttctctggttaacttcgcaaactcactttcaggaacaattgcagttgcagtatttgcagtcgcatataatgcaagtacatcagctgatccgaccaatgtagcactgatccagaatggtgtaaaatctgtattctggacagcagcagtcgttactctgattggacttcttttggtaatcttcattgtaaaaccggagatgagcaagaaagcagcagaaagcaaatagaatattgaaatccatgtgaacatgtgaataagaagccggggcggatgtgaaaaagcatctgccccggttgttatctggagaagtcttttataaatctgccggatacagggatgagaatggaaatgacatatgtttcaggtaaatgcagattgcatttcagaaaatcaagagtataataagaaatagtgaaaagaagaaaggcagacatatatctgtctttttataattatagagacaattttaaagatataagaaataatttgatttaccggaggaaaagaatgcttggaaactatctggatgaagtacgaaaaaaagcaccactgatacacaatatcaccaattatgtgacgatcaatgatgtggcaaatatggttcttgcctgcggtgcaagtccgattatgtcggatgagccgactgatattgaagaaatcacatccatctgtcagggactgaatatcaatatgggaatgctgaatccgcgtaagattgaaagcatgcaaaaagcaggaaagaaatccaatgaactgtatcataaagtactgttagatccggttggagcaggatcgagttcgttccgaacagaggcggcactgaatctgatacgtgatattcagtttgatgtgatccggggaaatatttctgagatcaagaccttagcagcaggacatggtacaacgagtggtgtggatgcagacgaggcagatacactgacggagcagaatctggagaaaatgattccgtttataaaggatttttccagaaggacaggttccgtgattgctgtgactggaggaatagaccttgtaagtgatgcaaagaggtgctttgtgatccggaacggtcgtccggagatgggacggatcaccggaaccgggtgtcagctttccgggatgatgacggcattccttgcggcgaatccggagaataatctggaagcagcggcagcagcggtctgtgccatggggcttgccggtgagactggctggaaatatatgcagccgggagatggaaacgcaacctaccgtaatcggatcatcgatgcgatttataatatggaaggaaaagaattggaagaaggtgcaaaatatgagattagataagaaagatatggttctgtatgcggtaacagaccgccactggctgaatggagaaagtctgtacagccaggtggaaaaagcgctgaaaggtggggctacatttatccagctcagggaaaaaaatctgggtgaggaagagttcctggcagaagcaaaagagattgccaggctctgtaaatcctaccatgtaccatttgtgatcaatgacaatgtagagattgcaaagaaggtagatgccgatggtgtgcatgtggggcagagcgatatggaagctcttgatgtgcggaaaacactgggtgaggacaagatcatcggtgttacggcaaagacggtcgagcaggcgctaaaggcacaggcacatggagccgattatctgggagtcggtgcagtctttggcacgacatcaaaggcagatgcaacaaagctggatcataaggttttaaaggaaatctgcgagacggtggacattccggttgtggcaattgggggaatcacggaagagaatgtgacagagcttgccggaaacggaatctgtggagttgccgtgatcagtgcagttttcggacagccggatattgagcaggctacaaaagaattaaaagagaaagtagaggggatgttgaaatgattttgtttactagcgattacacagaaggggcacatccgagaattatcgagaagcttgccgagaccaatatggagcagacagtaggatatggggaagatccttactgtgaagaagcgagagaagcaattaagaaggtgtgtgaagcaccggaggcagatgttcattttctggtgggaggaacccagacgaattttacagtaatttcttctattttacgcccgttccagggagtgatctgtgcagatagcggacatatcaatgtccatgagaccggggctgtagaagcgaccggacacaaagttctggcacttccttcaaaggaaggaaaaatcacaggacagcagataaaggaatattacgacctgcactggagtgatgagtctcatgaacatattgtacagccaaagatggtttatatttcacatccgacagaggtaggaacattgtatacaaagaatgaacttgaaaatatttctactgtatgtaaggaatgtggattttatcttttcctggatggggcaagaatgggttatggactgatggcaccggggacagatgtgacacttccggatattgcaaagtgttgtgatgtattctatattggaggaacaaaggtcggtgcattgttcggagaagctgtggtaatcacaaatccatgtctaaagcaagattttcgttactgcattaaacaaaaaggtggaatgcttgcaaaaggaagactgcttggcgttcagttcctggagctttttaaagatggtctttattttgaaatctccaaacatgcgattgatatggcaatgcttttgaaagatggactgaaagaaaaaggatatgaattcttcatggacagcaataccaaccagcagttcattattgtggaagatgccaaattgcaggaaatccgtcaaaaatatggcgtaacttatcaggaaaggtacgatgagacccatagtgtgatccgattatgcacttcctgggcgacaaaagaggaaaatgtgaaggcattcctgcaagatatgtaatttgtgaaaaattgaataaagctttacaggtaaggcagatatggtaaatgataaggacttttttgcacagaaaatggcagaagagtccttttttgcttttcgtagtgttttaatatgagaaaataataattaggcatttaattatttgtttgtgaaaaatattataaaaatataaattattgagaataaatgttgacttatatgtgtgatacgcataaaataacgattagacttctaatgaatagacatctaattaaattgcgggaggtgaaagggtgaagtcggataaatttgagtgtggggattttaccagggagaatatgccggtacaacttcttcttgcacaggtcggacatatgtataaatggtatgtgacgaaccagatgaaggatacagagctgaaagccggacaggcaggaattcttgcaatattgcagatggtaggaccgatgtcacagagagagcttgcagatcatattcacattacgccgccatcggtgaatgtagcagttcagaaacttgaaaagctcggatatattagaaaagagcaggacgaaaaagaccagcggatgacaaggatccatctgacagaacgtggagagaagattcttggcaacatgcatgagattctccgaagcacggaaaatacactcctgaagaatatgagcacagaagagaaaatactgtgcagaagactgcttttacagatgagtgacaatcttttccaggaaaaagaattccgtgatatgccatgtaaaaacccatttgaggaataaaaatagttactaagaaaggaaataattgctatatgagaaagctattcaaacatttgaagccttatgcagcaactatagcagcgattgttgttatcctgatcgttcaggcgtactgcgatctgtcattgccttcttatacttcagacattgtcaatgtcggaatccagcagggaggaattgatgagaagattccggatgcaatcgcagaggaagagatgaataagctgttgctttttgtggcagaagaagaccagcagacagtgctggatgcatatgagaaaaaggaatccgattcggattataagtatgatggagcaatttatgttctgaaggattccgtgaaaaaagatgaagaaaagtcaggaaaggtatttgacatccttggaaagccgatgcttctgacttatggatttgaatctggaagcgatacaacaaagaagatggaagaatccatgaaagaaaacatgatttcttctataaaggaacaggctgagaaacaggcagagagtatgcagtcccagatgacagatgagcagaaagcagcacttgcggcaaatccggagcttgccaagaaacagcaggatgaaatgcagaaaaacattgatgaacaggtgaaaaagatcgaaaatgcagatatctttgagatcctgaacatgataccggatgaacagagagcagacgttattgataaaatatcagaaaaaatggacgatatgccggatactatgctggaacaggcagcaacttcatatattaaagaaacctacagtgttctgggcgtgaatacagataagatccagaacagatatattttaacaactggcggtaagatgcttgcacttgcatttcttggaatgctcgcaagtgttaccgtaggacttcttgcttccagagtggcagcaagtacgggacgtgatctgagaggaaaggtatttaaaaaagttgttggattttccaatgcagaatttgacaagttttcaactgcatcactgatcacaagaagtaccaatgatatccagcagatccagatgcttgcagttatgcttttgagaatggtgatgtatgcaccaatcatggcaattggaggtatttttaaggttctccatacgaatgtcagcatgtcatggatcatcgtacttggggtaatcctgatcgtgatggttgttgctgtattatttattgtggcaataccaaaatttaagattctgcagaatctggttgacagactgaaccttgttactcgtgagatccttaccggactttcggttatccgtgcattcagtacagaaaagcatgaagaagaacgatttgataaagcgaacagagatctgacaagaaccaacttatttgtaaaccgtgccatgacatttatgatgccgatgatgatgctgatcatgaacggaattaccatactgattgtatggagtggcgcacatggtgtcagtgacgggcagatgcaggttggtgatatgatggcatttatccagtatacaatgcagatcatcatgtccttccttatgatctgtatgatttctattatgcttccaagagcagctgttgcagcagaccgtgtggatgaaattctgaccagcgagacagcaatcgaagataggaagacaccggaaaaactgggtgagaacggaaaaggtgaagtagaattccatcatgtatccttccgttatcctggagcagaagaggatgtgcttcacgacatcagctttactgcaaagccgggacagacgacagcaatcattggaagtaccggaagtggtaaatctaccatgatcaacctgattccaagattctatgatgtgacagagggatttattaccttagacggaaaagatgtccgcactctcacgcagcatgatctgagagaagaacttggttatgtgccacagaaaggtgttctgttctcaggaaccatcgcttctaatattctgtatggcaatccggatggatccgaagccgagatgaaggaagccgcagaaatcgcacaggcaactgagtttatcgaagagaaacataaaaaatacgaaagtccgatcgcacagggcggttccaacgtatccggcggtcagaagcagcgtctttctatcgcacgtgcgattgcaaagaaaccaaaagtttatatttttgatgacagtttttcagcactggattataagacagacgtaacccttcgtgctgcattgaaagaaaagacacaggacagcacagtgatcattgtagcacagcgaatcagcaccattttacatgcggagcagatcattgtgctggatgatggaaagattgcgggaatcggaacacacaaagagcttctgaaatcctgtgatgcatattatcagattgcgtcatcgcagctttctgaagcagagcttgcgagagacttaaataacgaaaatgacggaaaggaggaagcatagtatgagtaatcagccaagaagaagaggacctatgggcggtggacatggaagaatgggaaccggcgagaaggcaaaagacttcaaaggtaccatgaagaaactttttacttaccttagtgaatataaaatcggtattttctttgttatgatatttgcaatcggaagtacggttttcaatattattggaccaaaggttctcggaaaagcgacgaccgaaattttcaaaggtctggtcggaaaagtatccggcggtagcggaattgattatacaaagattggtaaaatcctgttaactttattgtgtctgtacgtgatcagcgcatgtttctcctttatccagggatatatcatgacaggcgtatcacagaagctgacctatcgcatgcgaaaagaaatttctgagaaaattaaccgcatgccgatgaattattttgatacgactacacacggagaagttctttccagagtaaccaatgacgtagatactctgagccagagcctgaaccagagtgcaacccagatgatcacatccgtgacaacaatcatcggtgtactgatcatgatgatcagtatcagtccgctgatgaccgtgatcgcacttctgatcctgccggtatctatggtactgatttctgtaatcgtaaaacactcacagaaatacttcaaaagccagcaggaatatctgggacatatcaatggtcaggtagaagaagtatatggcggacataatattgtcaaagcattcaataaagaagaagatgtgatccgcgaatttgatgagactaatgatatcctgttccgttctgcatggaaatcacagttcctttccggaatgatgatgccgatcatgcagtttgtcggaaaccttggatatgtaggagtttctatcttaggaggttaccttgcaatcaaacagaccatcgaagttggagatatccagtcctttatccagtatgtaagatcctttacacagccgatccagcaggttgcacaggtagcaaacatgctccagtcgacagccgctgcatcagagagggtatttgaatttctggacgaaaaagaagaagatcagtttgctgaaaatccagtatctgtagaaggattacagggaaatgtagaatttgaacacgtacacttcggatacaatccggagcatatcatcatcaatgatttctctgcaaaagtaaaagaaggacagaagatcgccatcgtaggaccaaccggagcaggaaagacaaccatgatcaaactgctgatgcgtttctatgatgtcaacagcggggcaatcaagatcgatggacacaacatcaaagacttcaaccggagcgaactcagacagatgtttggaatggtacttcaggatacctggctgttcagcggaagcatcgaagataacattaaatacggtaaactcgatgcaacccacgaagaagtcgtagccgcagccaaagctgctcacgtacaccgtttcgtccagactcttccaagcggatacaacatgatcctcaacgaagaagctagcaacgtatctcagggccagaaacagctcctcacgatcgccagagccatcctggctgaccctaagatcctgatcctcgatgaagctaccagttccgtagacaccagaaccgaagtccagatccagaaagccatggataacctcatgaaaggcagaaccagcttcgtaatcgcccacagactttcaaccatcagagatgcagatcttatactggtaatgaaagacggcgatattatcgaacaggggaaccatgaagaactcctggtaaaaaatggattctacgcagagctgtataactcgcaatttgaaaacgctacaagctgtgcataaaaatggaaagatgccaaaaatcatgctcgcatgatttttggcatctttttatttttatatagagcgccagctctcattcggatgatgcgacagcattagccgaatgcagcacagcgtatgtgtcggggcaaaagagtagagtgcatcattccacaaactaatcaatctccagcggaacaggagcttcagctccgcttcccgcgcctgtcttgcgttccctaaatttaattcaattattttccaacatctctagcaacgccgaatttgttgatttatttatgatttctgtaattttcaatcaaccagattaaacgaatttgttgatctgtttttaatttctgaaattctaaatcaactatatctgcatatttcgttgattagctttgaattttacagtatctaagtcaataaaatattcttattctgttgacttgtttttgagttttatagtatctagatcaataatagttccttatttcgttgattcattttcggcttttaagttttgcaatcatttttttcagtataacgcatgtaaaaatgtgtatcaatgaagcaaaaaataaatatgaaaaactgtaaaaaatattgccatcaataaaaatcatatatatgatatttataaagaacaaaggaggtttaaaataatgcctatgaaaaaaagattatccagttccattggtactattattgttctctgtgcgataattataatatcgttgcagaaatatcagccggataaagaagtaattactactttcatatatgaatggctaaatgacgattccagggcagagacagaatacaaaaaaattctggaaaccggaagtgataatcaatccttatctcagcctttgcaaaaatacttcataacagaagcggcattccaatctttcttaaagacattttattatttaccagtaaaaattctgcaacaatacgattcctacaatttaatagacattaacataacaaaagaatctaatagttactttgtaaaagtagacttagaattgataaaagaagaaaaatcaaagaatcattccatcacaataaaaattcaaatggatcataaaaagtttacctattttaccatcacagaaggaaaagaaatttaacacaaataagcggttgaaagataagaaacaaataggatataataacccatagatattcaggaagggaggaaatctttcatgcaaaaagtaatcagtatcggaaaacagaattttgtatctcttcgggagaatgattgtttttatattgataaaacagatctgatctgtaagtggtgggaatcaaaagatgaaattactttgatcaccagaccgcgtagatttggaaaaacattgaatatgagtatgctgaattgtttcttttccaatcaatttacaggacgggaagacctttttaaaggattggcagtctggaaaaaggaaaagtatcgtaaaatgcaaggaacctatccggtaatttttctgagttttgccgcaattaaaggcagtaattatgaagatgccagagatgggattatcatggcgatcaatgaagcctattcagaacataggtatctgcttgaaagtaatgaacttacggatggtgagaggaaatgctttgaagagttagattattatgcaaaaaatccaggaattaaaaaacaggtggcaaatgatacaatctgtaatgcggtaaaaaatctggcaaattgcctgagccggtattataaaaagaaagttattattttgctggatgaatatgataccccgatgcaggaagcttatctctatggatattggaaagaatttacagcatttatcagaagtttatttaatgcaacgtttaagacaaatccatatttggaaagagcaatgatgacagggattacacgcgtgtcgaaagaatctgtattttcagatttaaataatcttaacgttgtaacaacgacatcaacggagtatgaaacctgtttcggattttcggaagaagaagtatttcaggcgttagaagagcgtgggatgaacaatcagaaaaagcttgtaaagtcctggtatgatggttttgtatttggaaatacgcatgatatctataatccttggtcaattactaattttttagataaaaaacaggtccgtccttattgggcagataccagttcaaatagtatgattgatgaactgattcgaaaagcttccacagacatcaaagaaaagatggaagaattgctgcagggaaaagaaatcgtagttaattttgatgaacaaatcgtatttgagcagcttgatcaagatgagaatgcaatctggagcctgatgctggtaagtggttatctgaaagcagagcagatagaatatcggggcgttttgttagagccatggtatcatctgcgaatcaccaatctggaaacaacagcaatgtttacaactatgtttaaaggatggttcgcaaagaatcaatccaattataatcagttcatgaaggcattattaagtgatgatatagatgctatgaactattatatgaatcagattataatgacaacattcagttattttgatgtaggacaaaatgaaccggaacgattttatcatggatttgttctgggactcattgcggatcagactgatatctatgagattcggtcgaacagagaaagtggttttggacgttatgacgtgatgatgattcctaaaataaaagaaacaaaaaagtatccggcgattattatggaatttaaagtgagaaatataaaaagagaagagattcatcattatggttttgcatttgaaggaaaaaaagtattgataggataaaaagaagaaagtcaaactgctattgcgatttaaaactttttcatatagcagtttgactttatccgttttatagattaatgtaaataaaatcccagatccaatatacattccggaggcagatattctcgcggaatattcacaagtgcagtaattttccataagataccaaatccaatcagaatgagtagcattcctctgacacattttctataatctccggcaggaaacttatacaaatctttaattccaaaagcaaagataaaaattaaaatcaggacggtcattccaaacaaaaagaaaaaagatttttgcttttctaaaatacgtctgttttcaccagactgttttttatgttccccttcctgatcgatggtgacttcatctccatcttttaatggatatgtagaccattttatgatctgcaaaagttgtcctttttcatctttttcttccggaagaagaatactatctgcggttatggaaagaggatcgacagcctttgaaaaggcgagaaattttgttccgaatactccttcttgctctgccagataaaaaatcatatttgtatcggtattatagcaacttttgggaatacggatggtagaattaagcttttcttcttctgtctgactgatcgttgcaatctctacaggtatctgcatccatttttctatacggatggataaaatagtacagatcattaaagaaatcaggatcatacatccggcattccaggttttctttttcatcattttatcaactccataaaatatcttttagtccatccgtcaattctgtattgtaatataaaaagaaaaatgtcactggaagtaaacatagtagaccacagacggattgaattccaacagcattttgattgagtgatgcgagaaaaacagaaaggggatagtcggtttctttttcgagaaaaaggataggctgttcaaccatattccagctttctgtaaatactaatataaataatgtgataacggcaggttttgaatttggaactataatgtagcgaatcatttgtagctgatttacgccatccattcttgcggcatcaagtgtagaatctgggattgcctggaaaacgaaagtaagccatacagttccaaaaggtgaaaatattgcagggattatcaaagctttccaactgtttaaaagttttagtttttctaataaaatataattcggcagcagtgttacctgaatcggtaaaatcataaatagtgcaaatagtataaaccagaattttttcagaggaaaagaatattttgcaaatgctgttcctgacatacaggaaaaaagggtttgtcctgtcgcaatcatcagacacatggcaaggcttctccaaaattttatcagataatcaggttttgccagaaaaactttataataattcatcagagaaaatccggtatctgaatgaaaaactgaaaatacaatcagatagataattggaaataaaaaaataaaggctatgatcgaaaaaacaaagagccgggtgtactgtttgtacttatgcatcggcagtcctcctctttagaaaatagtatatcatatagataagaccacttagaaaaagaataaatacggtaataatagttgcactggcggaaaccttttggtaattcagattttgtaaattattattcataaaatgttgtaaaaaataaatactgttgtctggatgagttccgccaagtaaaaaggcttctctgtagcatttaaacgcattcattatggagagtattaatgtaaaaaggataaccggaaacaatataggacaggtaatataataaaagctctgccattttccggctccgtgaagactggcatattcataatattctttcggaatcatctgaagtctggaagaataaatgaaaatataatatccaacaaatttccagaaatataaaatacagatgatccaaaaagcgcttgaggtatgaagccagtctttttcaggaagataaaaaaagtttagtatcagattcaaaaaaccattatttttgaaaaaaaactggatgactaaaactatagatgcgattggcatgatgattggataaagaaaagagagtcggaaaattttctgacctttcgtaatctgttgtaaaattacagaaatacagagagctgtccctaaagtaactggtattgtaacaagcatatatttacaagtgttttttactgccagtaaaaacattgtatttttaaatagttctttataattatcaagacctacaaattcgcgttttccgataccaaaagaaacagaataccacaaaacaatcaaaaatgggatcagataaaagaaaagaaatcctgatattgcagggaaagccagtaagaatcccttcttcttttttttcattgcatcacgctcgctttcacttaaaactattctgtcacctgtgtatgataatcattccatgctttgtctgctaaagccgaaagcttatcttgccatatctttttaaaatcagtttgcggaccatataataaactactattttctataatctcttcataaataaaatgttcaacttctgtcggaaaatatgctccttctaaggactgaaatgcttttatagctaaatcctgttttgactgatctaagaaggacagttttgtacggatggcagatacttgtaccggataatctgttccaaggacaccatttgcgcttagtgacattccattagtactagttgattcctgaattacgttatttaaaaaatacattaagaagtgataagcttcttctttataatcagatgccatacttacagcaccaaagcaacgaatggcagccattttttttccctgaatatcagggattatgtctatttgcgttgtgtgttcgtttatgtcatccaaagatgagattaaaatatgcgaagagctagtatcagtattatttgtcttttcattttctaaataatcttgtttaaataataagtattctaatgcgaaattactccacttttccttatcaaagaaaatctgaccggaattgtaatccgcagcaggttgaaaccagttaccactgatattatctaattcgaatagtgcatttttcagagcgtggtcagaagaactttttatatttgaaatccaatcttctaaggtatcattttcctgtgtataatcaagtacagtatcggagattaacatattatagtggcaggaaagaggaagaatatattgtctttcctgatattgaccggggagaagaaaagacggattatagttttccttttgccaataagaatcttttttcatatatttatccaatgaggcgaatacaccactttgcattgccttataaggattttcaaaaagaggttcgttcatctgcgcagctccatcggtggaacagttaacaagatataagtcaggaccttttccagacatgatctgtgtacggagtttctgaatttctgcagatcttttatcaggatcaggagataatattttaatttcaaattccagagagttatttttggatgtggcatattttacagcatcaagaacctgctccttaaaagcaggttctataacaatagagagtgttttggagacatctttatttagctttgtacatccggataatccaattgaaaggatgaggagtggaagaagagcaaatttaaaattgaacattggtatgatccatccttaaaaattacaaagtataattgattgaatttaaatgatgtatatatcttagtatctgaattttaacacaaaaataaaacgatgtcaaataataaagaaattttttgaaaacgaagtagttcgtatgattttgttgattttcgaagaataccagaggacgcttgcatttcaaaaaaatacaagttatccttaagaagatgtacaaaggaggaaaagaagatgcagcttgcaacagcaatgaatctaagaaaagcaatggatgaggaaaccaaaagagagcggttcgcttcctggtacagcacactgcccggaatcccggcacatgaaaaagagatcatagaaaggtctttaaaatataacgtgtggaaagaactcataaaactctttgtcgtttatatgatcctttcactggtatggtttttcggagccggtcagtatgatccgtttgaaagtgtaacaggatattctctcataggaaaaaagagcgtaattggagttgtgcaggaggatggcgagtcattgcgcttgaaaaatccgaataaaggtgagcatgtaagttacacacttgcagaacttggaatggatccgatcaaatattcttatggcagtcggtttcagacatactgggaaaaagaaaagaatggggaatatcagttacttgcggtattgccggaaaagcaggtatcgaaaatagaaggtctttattatggcgtaatgggagtcggatattttgcaattcttattggcgggatttgtgcgttttttatccggagaaaacgatatacaggatggtttttatcgttctattacaggctggaaaagttttactcagaatatggtgtatggcagaaatacagtgttgaaagaggttatgacacggtcgatgcgattattgcttacggaaatgaaaatccgatatattttgtaaacgaattttcgaatatccatctcacaaaagaggaagtaaagaaaaagaaatcaaagcttgccatggtctggctaacatcaatagcggttatggctgggattatacttgttatttcactgtatgtgaatattacgtcagcgatcgagtgcaggcaaaatgaggcaaggacagcagcagttttagaaaagctgcagaatgcgatcgatgaaaaaacgacaggtcttggtgacaaatcggaatattacaattatgcggacatgatcgaccgggcaagggatacattcccggaagaagatatctactacaagcttcagacaacggaggattatgtcacgataattgtcacaacaaaaaagaaacaaaatgtctgctttgaccggtatgtgccggttcagggatcaattggtgatgaggatacagagtataagcttgagattgccatggtatcggatgcgatgcagccggacgacattttacataattatacagggatacttaagataaagtaaggtaatggcaaaaagatgattctgcgaaaggacgaaggagaaaatttatgaaaaagaaaagatttgcaatggcagcagtatgcgcagtcatgactatagcgcttgcgggatgcagtatgctcagctccaaattgaacgatattacaggaaaattagtggggaattcgtacacgatcacgacctatgataattacgggaatcgtgtaatgacaactacaggagacaagatcaatgtgcagggaaatgcagtggaaacttcaagctatgattcagacggtaatgttatcacaggatatgagctttcctctgtcattacgattacaatcgatggaaaggaaatcgagagttgtggtgatacctgtatttttgcgcaggacgcgttgaaagcggatgtggattttacgcaggaggatattgaaagcaatgcaagcggtaagattacagacaatactgcgatcgcaggtgtcctgaataagtataaaaatatgtttggaaaagccagagtggttgttatcaaatcccagcttggacagccaatcgtagcgtatagcggagaagatgtgtactgggaaatcccggatgatctgccgaaatttacgaagttgatgatcgatgggaaagcgttgtacatacaccgggcaaatttccagattatggataagagtttgttggaatccaactgataaatttactgcgtcaaagttttagagctgatataatcaaaacatgggtgctaccataacggcaggtggttagtcctttttcagagggtgcagagtgctagtggcactcgttttgcaacgaccgaagtagaacggagacctgtgaccctctgattacatagaaaccttgataaggaatctgctggaaaggagggctaagccaatgagtattttggattttattgcagttgtgagttttggaatcacctgcttttgtgtcggatacacattcggcaaagataataataagacacaagaataaccgccccagcctgcaaactgaacggttatttttaatcaattagtataagggctaaccgtctatcggtagcactctttttctatagtcatattatcatgtgtctgttgaaatgtcaaattttcttactttaaattggggttaaaaccttatattttaggtcaaaaatttttggtttatattttgttagcatttctgaaaaaaatttttagtgtagaaaaattcacagtttagattcaaacttatttctcaaaaatatattttaatagagagccacattccaaagaaaatgagtaactgtaagtgagagaatgctaaatttatcagggaaaaaagttcttaaagaacaatataaaatggaaataatacatgtattaataacctgtgtaaaagaataagtaacaggaaaatgcatcaatccaaagaaaacagaagtaataaaaatagcaaagaaattatttgatttctttgacaaaaaagtcaaaacaaatccacgccagagaatttcttcggtcagtacatttaaaagcatattaaatatgtagaaaaagttagctatgtttattcggtcaaatttagcaattatattacggagtgcttcagaaaaaggtggtggggataagaaagtaaaacggaaaaagattcccataaatacataaagaacgattccacaaaataattgaattattggtttatgtaaatgaaatccgtattcttcaagagacttattatagacagaaatataaattataattgcaattgacggaataatcgtaatcaataaaaagagcatttctgaaataagaccattcaaatatacatagataattctttgcaataaaaacgcacctaaaagagtataaattgggagagctaagaaaaatatccattgttttgttgtagatttcatacagaatctcctttttgattttcttgtgtagtaattgaaaggtcttgttagttaaactggaatacagaatcttttttttcacatctacaaaatgaccgcaatcaatcacttgccgcccaatgatcagcgcggcgatcattccggcaaatacttttgcgttcacggatcattaaatatccgtcgagcctgtatccgtacacgataaaaagcagggacatcaccagagttgggatggtcagctctttaaagaacagcacgatcaggcccacgccgattccggcgatagagaaacaatagccaagcgagatgaaccagacaatttttttaaacccgatcgaactgatgaccagtgcaataatcagtaaaattagaaacttcatatgtatgtcttttttttgtaaaattgaattagtataatgataacacttttgcggaaacaggtaaagtaaagttattccgtgcttgcatttccccaaaataccagttatccttatcagtatatcaggaggaggcacaaaaacatggaagaaacaaaaaagttatcatgtatagactgtaatgttaagaaatgcaatgcaaagcagaatatagagaacaacaaaccatatccgggattttgcgtgtcacataatatggacttgaaagaccggcagagggcgcttgatacctatctgggagatgaaaaagatctgaagatcatgcgtgcaagtgccgagatcgagcacgatttttactgccaggcaacccgtgtggaggagacgatccgctgggcaaaaaaactgggtgccaagaagatcggaattgcaagctgtgtgggactcttaaaggaaagccacctgctggcaggacttttgagagaatacggctttgaagtgtacggtgtgggctgtaagatcggagaagttccaaagaccgaggtcggcattccggaacgctgcgaggaggtcggagttcatatgtgtaacccaatcctgcaggcgcagatgctgaacacagagaagacggacatcaatatcgtgatgggactttgcgtgggacatgacagccttttttacaaatatgccgaggcgccgagtacaacgctggttgtaaaggatcgggtgcttggaaataatccggtggctgctttgtatacgctggactcttattacaaaaagttacatcatctgaatctggaggaagaataatgcacattcgacatattttatttgatcttgacggaacgctgcttccgatgaaccaggacgaatttgttaccttttatatgccgcttctggcaaaaaaatatatatccgaggggatttcctttgatccgaaagcatttatcgcatccgtgtggaagggctatggagcgatggtgaataatgacggaagctgtaccaaccgggaagcattctggcagtatatggacgaactgcttccgacggattcggagaattccgaacggattgcccttgatttctatgcaaatgaatttaaccaggcaattgcggtgacgcagccaaacagtctgtcggacaaggttgtgaaaaaggcaaaggaaaaaggaatccgcacctaccttgcaaccaatccggtatttccaaaggtggcaacgatgaaccggatcaaatgggcgggactggatgcagaggattttgagctgatcacaacttatgaggataattgttactgcaagccaaatgtggactattaccgaacaattcttgaacagtttgatcttagaccggaagagtgtctgatggtaggaaatgacgtggaagaggatcttgcaattcggaaactgggtgtaaagacttttcttgtgacggatacgaaggaaaataaaaaggatcttccaatcgaaagcgattatcagggatcgatggaagagctgtttgcatttgtggaaagcctggaaaatgcttaaaaatttattgaaattccaaacttttattgtaaatgcatggcggacgtggtaaattattctaagtagtatccggagagaaccggagaagagtatatgataagaaacagagggaaactgatatgaagaaaaagttacttgttgtttgtggcggacagtccagtgagcattcaatttcacgaatttcctgtaattcagtgatgaagcatctggataaagataaatatgagattacacttgttggcattgcaaaagatgggaaatggtatatcttaaagcaggaagataatgacctgtcaaaagatacctggcttgacggagcagaagtggtagaaggtgtattcgatcttctgagaagtcaggatgttgcattcccggtacttcacggactttacggagaagatggaactatccagggattatttgaactggcacagcttccgtatgtaggatgccgtgtatttgcatccagtgcatgtatggataagatttttgcaaagaaagtatttgaaagtgcaggaattccgcaggttaaatccgtatatgtgaaaaaacgaaatgacggaagactggtcgttgtcgaaaaagacatggaagaaacagaagaagtagaagcttcgattatgaaagaatttggtatgccatgctttatcaaggcaagccgttccggatccagtgttggatgttaccgctgcgataaagaggaagatctgatggcaaagctggaagaagctgcgaagtatgatacacacatcgttgtagaagaatgtgtagactgtatcgagcttgagacagccgttcttggaaatgatgacatcatcgtatccagagtcggacagatcatgccacacggtgaattctatacctttgaatccaaatatgaagatgcagagagcaagacatgtatccctgcaaaagtagatgaagagattcaggaacagatccgtaagtatgctgttcgtgcctttaaggcaattgacggacacggactgagccgtgtggatttcttcctggataagaagaccaatcacgtttacctgaatgagatcaatacccttccgggatttacgagtatctccatgtatccgcagctgatggaagatttgggatatagttattctgaactgctggataaactgattgagattgctgatgagaactagttaaaaagaatagaagaatgtttattactgccaccgatgatggtggcagtttttttattacataggaaatttcgtttcctatgtaataaaagcctccggcaggatgcgcactgcggcgtataatgaagatgtcgcaaacgacttctacaattcatagtgcataatgactaaaaatctgtaaatacaaaaaaatattgaaataaatctgaaaataatatagaattaaagtaataaaaaataataatggaagaggagatgatcgcatgaaaagaaaaaataatattttactgatttcgattcctttaggtgttctgttgcttttatattatggttacattgcattggatacttggctccaatttcaaattagaacaggaaatggcatttcagcagcaaatggtgaatggattttatctattcaatacacgtttctttttatactgaaatggtttggcccggttttattagtcgtatgtttgtacggaattctaaaatggataaaaaagaaagaataaagaaaaagctccagaatcagcaaaataattgttgatcctggagcttatttagaagaaacaatataattttagttctctttactatattccagagaagcttccacaaatcccttaaacagcggatgtggtttgttcggacgggatttgagttccggatgtgcctgtgttccgatgaaccaaggatgttccggaatttccaccatctctacgattctgccgtccggagaaagtccggataagagcataccgttctgagtaagagcatcacggtagtcattgttgacttcataacgatgacgatgacgttcgtggatttcttcttttccatataatttataagcttttgattctttgttaagaacacaaggataagaaccaagacgaagggttccaccgatgtcttcaataccgatctggtcaggcatgatgtggatgaccggatgtgtagtgtttggattcagttctacgctgtgtgcatcatgatatccgacaacgtctcttgcaaattctacgatggcaagctgcattccaaggcagagtccgaggaacggaaccttatgtgttcttgcatatttgatggcttcgatcttaccttcgataccacggtcaccgaatccaccaggtacgaggataccacttacatcaccgagaagttcatcgacattttccgatgtgacagtttcagagtcaatccatttgatatttacggttgtgtggctgtagatgccgccatgttttaatgcttcaacaacactgatatatgcgtcatggagctggatatatttgccgaccagggcgactgttacatcttgtgtcggatgtttcaggcattcgaccatctctttccagtctttcagatccggttccggacagtcaagcttcaggcattcgcatacaacggaagcgagatgttcttcttccatggcgagtggtgcttcgtaaagatattccacatccaggttctgaagaacgtgatcagatggcacgttacagaagagggcgatcttgtctttgattccctgatccagtggatgctcagaacggcagaccagaatatccggctggattcccattccctgtaattcttttacgcttgcctgagtcggtttggtcttcatctcctgggaagcatgcagatatgggatcagtgtgacgtggatcagcgcaacattgtcatgtcccatgtcatgctggaactggcggatagattccaggaaaggctggctttcgatgtctccgacggttccaccgacttcgatgatcgcaatctcggtatctgcagctgcagggttacgatagaaacggctcttgatctcattcgtgatatgcgggatgacctgtacggttcctccaccaaaatctccacgacgttctttctgaagaacggaccagtaaatctttcctgtcgttacattcgagttcttggtaagactttcatcgataaatctttcataatgtccaaggtcaaggtctgtctcagctccatcgtctgttacaaaaacttcaccgtgttgtaccggattcattgtacccgggtcaatgttgatgtacggatcaaatttctgcattgtaactgtgtacccgcgtgccttgagcagacgcccaagagaagctgctgtgattccttttccaagacctgagacaacgcctccggtaacaaatacatacttaactgccatagttccagttccctccttatggtaattgtttttgtctactactcattgtgttctgtaaaaaataagatagaatgcgatttctattcatcagaaaagtccggtataaccttctgacggataaaaatagaaaaaaaccccataaaaacaaatttatgtggctccctcgctactttgatttccccttgaaatcaattcccctataaaatactttaaaagtatacacccattccagaaaaaaatacaacaattttttttgaaatgggtgtataaaaatcaaaaatataatatttatctactgatagatcggttttttctcgtatctcggttcagatgtaacctggatggataacttctggaacagacggatatctacattcgcaagcataacggatacatgagcctggcagccttttaaattcgggacttgtctgagtgcctgttcagcaaccggattggaagaggcactgatagaaagtgcaatcagagcttcatcgatgtgaagtcttgggttcttgcttccaaggaattcggttttaactttctggatcggttccagggcagtcggtgagatcaggtgcatatcatgatcgattccggcgagttcttttaaggcgttcaggatcagggcagcagatgcgccaagcagatcagaggtttttcctgttacgatgcgtccgtccggaagctccagagcggcagccggtgcaccggtttcttcagcgcgtgcaagggcggcatcaacaaccttacggtcatgtacggtaactcctgcctgattcatcagaagctcgaccttataagtctcttccttcgggcattcaccggaaaggaaacggtccatggtgcggtagtagcggcgaatgatctcctgacgggaagcttctttgcagacttcatcgtcacagatgcagttgccagccatgttaacacccatgtctgttggtgatttgtatggattttctccgtaaatgcgctcaaaaattgcactcagtacagggaagatctctacgtcacggttgtagttgacggtagtaacaccgtaagcttccagatggaacgggtcgatcatatttacatcgttaaggtcagcagtagctgcttcatatgctaagttgaccggatgctttaacgggatattccagatcgggaaggtttcgaatttggcatatcctgcgcggactccgcgcttgtgctcatgatagagctgggaaaggcaggtagccatctttccacttccaggtccaggtgcggtgatgacaaccagaggtctgcttgtctcaatatattcgttccttccgtatccttcgtcacttacgatcagcgggatgttggaaggataaccttctattacataatggatataaactttaatgccaagcttttccagacgtcctttgaaaagatcggcactgttctgtccggagtactgtgtgataacaacacttccgacaaagagaccattggcttcaaattcgtctttcaggcggagaacgtcagtgtcataagtgatcccaaggtcaccgcggattttgttggcttcaatatcggctgcactgataacgatcacaatctctgcggtatccgataattcttttagtaaatgtaatttgctgtccggctgaaatcccggaagcacgcgggaagcatgatagtcatcgaaaagctttccaccgaattcgagatacagtttgttgtcaaactgattgattcgctcacgaatgtgagaagactgcatttgcaggtatttttcattatcaaacccaattttcataaagttccatcctttttgtccataattttactttcatagaagcaattcaaacctagtatactataaaatatgacttttttacaatcttttcataaatttttcattgatttctaaaaaacgcctacttataatagagaggacgacatttaggaggtaggtatggataaccagaataatagaaataagcaaaaccttccgggaaataataacccgaataataaaaataaccgccaaagatggaatattatattatttaccgttatgctgatctcgtttatcgtatttgcgctgtatcagttccgggaagacacagatgcccgggagattacctatgatcagttcctgaacatggtagattccggggaagttaagaaagttgtgatcgaggatgacaagattgtgatcacagcgaagacagaagctgagatgaagaacagcaagaaaaaaggcgcttctgagagcgatgtggtcgaaggttctgtagcagataacaacgacagcagcagtaaggacagcagcgatgacagtacaggtctgttcagtaatgtgacaaggaagcagtattataccggtattgtgaaggatgataccctttcggacagactgtataaagcaggtgttgagtatgaacagaagataccggattctacatcttatatggtgatgaatcttctggtcaacattgttccgcttgtgatcatgatcggtctgggcgtgatgctgatgcgccgtatgacaaagggtggcggcatgatgggcgttggcaagagcaatgctaagatgtatgtggaaaaatctaccggagtcacatttaaggatgtagccggtcaggatgaagcaaaagaatccttgcaggaagtagtcgatttcctgcataaccctggcaaatacaccggaatcggagcgaagcttccgaagggagcacttcttgtaggccctcccggaaccggtaagacacttcttgcaaaagcagttgccggagaagcaaaagtaccgttcttctctctttcgggttctgcatttgttgagatgtatatcggtgtcggagcgtcaagagtacgtgacctctttaagcaggcacagcagatggcgccgtgtattatttttatcgatgagatcgatgcgatcggaaaaagcagagattcacagcttggtggcaatgatgaaagagaacagacactgaatcagctccttgcagagatggatggatttgacagtaataaaggtcttctgcttcttgcggcaacgaaccgtccggagatcctggatccggcgcttctccgtccgggaagatttgacaggcgtatcatcgtagataagccagatctcaagggacgtattgatgtcctgaaagtacatgccaaagatgttaagatggatgagacagtcaatctggaagagattgcacttgcaacttccggggcagtcggttctgatcttgccaatatgatcaacgaggctgcgatcaatgcagtaaaaaaaggaagaaatgttgtatcccaggcagacctttttgaggctgttgaggtcgttcttgtgggtaaagagaagaaagaccgtatcatgagtcagaaagaacgccgtatcgtatcataccatgaagtcggtcatgcactggtaactgcccttcagaaggacgcagaaccggtacagaagattacaatcgttccgagaaccatgggtgcactcggttatgtgatgcagacaccggaggaagaaaagttcctgaataccaaggctgagctggaagcaatgctggtgacagcccttgcaggacgtgcagcagaggaactggtgtttgacacagttacaaccggagcatcgaacgatattgagcaggcaaccaagatcgcaagagcgatggtaacacagtatggtatgtctgaaaaattcggacttatcggactggaatctatccagaaccgttatctggacggaagagctgttatgaactgcggagaggcaaccgcggcagaaatcgatcaggaagttatgaagatgctgaagggagcatatgcagaagcgaagagaatgctttccgagcatcgtgaaacgatggatcagatcgccggattcctgattgagaaagagacgatcaccggaaaagaattcatgaagatttaccgcagatgtgaaggaattccggaaccggaagaaaagaaagaagagaatcctgtaaaagagcagacgatcgagatgccgaagaaagaggcagataccgaagctgcacagcaggaagagaaagaaacgcagaagaaagtagaaagagatgaagacggattcatccttccgcagaagcgtgactagtctaaaataatagaagatgcagaggtttcagaacaataggttctgaagcctcttttttctgtagattcttttgaaagaatgacttgtattgtctgcaggaagcaaggtataatgtgactatggaaaatcagacatttattattgaagacgaacttaaaaaacttcctgggaaaccgggagtctatctgatgcatggggaaaaggacgagatcatttatgttggaaaggcgatcagcctgaagaaccgtgtcagacagtattttcagccgagcaggaacaggggggccaagatagaccagatggtgacgcatatcacccgatttgagtatatcgtgacggattcggaactggaagcactggttctggaatgcaatctgatcaaggaacaccggccaaagtacaatacgatgctgatggatgataagagttatccatttatcaaagtgacaaccggcgaagcatatccaaggattatgatggcaaggcagatgaagaaggacaagtcaaagtatttcggcccttataccagtgtgacggcggtaaaagatacgatcgaactgatccggaagctttaccgtctgcgtagctgtaaccgcatccttccgcgcgatatcgggaaagaaagatgctgtctctatcatcatatcaagcagtgcgatgcaccgtgtcaggggtatatttcgcaggaaaaatacagagagtcggttgatgaagtactcaaattcctgggaggaaattatgataaaatcttaaaggatctggagaaaaagatgcaggaggcatcggatgatctggaatttgagaaagcaattgaataccgggagcttctgcacagcgtgaagcagattgcacagaagcagaagattaccgatacagggggcgaggaccgggatattgtggctcttgcaagagagcatgaggatgcggtggtacaggtattctttatccgcaatggtcgtctgatcggcagagatcatttttatctgcggattgcccagggagatgaaaatgcagagatcctctccagctttatcaagcagttttatgccggaacgccatatattccgggcgaactgatgcttccggtggaaccggaagagcgggagatcctggaagcatggcttggagaaaaacgtgggcataaggttcatttccgtatcccgaaaaaaggggaaaaagaaaagcttgttgagcttgcggcgaaaaatgcaaagatggtactggaaaaagataaggagcgtatcaagcgtgaagaaggaagaacgatcggtgcagtaaaagaaatagaaaagttgcttggtcttaataacctggtgcgtatggaggcgtatgatatttccaataccaatggatttgcctcggtagggtcgatgatcgtttatgagaggggcaaaccgaaacgaaacgattatcgtaagttccacatcaagggtgtgcagggggcagatgattatgcaagtatgcgtgaggtcctcaccagaagattccggcatggtctggaggaacagaaaagcgggaaagagctgggaagttttaatgtttttccggatctgatcatgatggatggtggaaaaggacaggttaatatagcactggaagtactggatgaacttcatatatccattccggtatgcggtatggtcaaagatgaccatcatcggacgagaggactctactatcagaatatcgagattccgatcgaccgcaattccgaagggtttcggctgatcacaagagtgcaggatgaggcacatagatttgctatagaatttcaccggaaactgcgtagtcagggacaagtgcattcgatcctggatgatattccgggaatcggacctgcgagaaggaaagcactgatgcggacatttgccagcctggatgagattaagaatgcagaggtggaagatttgaaaaaaattccatcaatggatgaaaaatcggcaaaaaacgtgtataattttttcaggggaagcgaaaaggaagatacagaagctactctgatggaagaacaataaaaggagacaggactatgggagttacattaacaaaaatcgtagagaagatggaacttagaaatcttactccggatgtcgatatgacacagcgggaagtaaaaattccggatattaaccgtccggcacttcagctcgccggattttttgatcattttgattgcgaacggattcagcttatcggatatgtagagtacacttatctgcagacactggaatatgagcataagatgaaaatatatgatacactgcttgagtatgggattccatgctttattttctgcagaaatctgcagccggatccggaatttctggagaaagcagtgaagaacaatattccggtatttattacggataaacagacttcttccttttcagcagaactgatccgctggatgaaagtggaactggcaccgtgtatttcaattcacggggtactggtggactgctatggagtcggtgttctgatcatgggagacagcggtatcggtaaaagtgaggcggcactggagttgatcaagcgaggccatcgtctggtaacagatgacgtggtggagatccggaaggtcagtgatgatactcttgttggtacagcaccggatattacccgccattttattgaacttcgcggaattggtatcattgacgtaaagacgctgtttggtgtgcagagtgtaagagagacacaaaatattgatctcgtcattacgcttgaggactggaacaaggatcgcgagtacgacaggcttggacttactgaggagtatacagaatttcttggtaataaggttgtatgccacagtattccaatccgcccgggacgtaatgttgccattatcgtagaatcagcggcagtcaaccacagacagaaacaaatgggctataacgcagcgcaggagctgtaccgccgggtacaggaaaatctaaaaaagaatatgtaaggagcaggagacagatgaaatattgttttggtatcgatataggcggaacgacagtaaagatgggactttttcaggaagacggagagcttcttgacaaatgggagatcaagacacgtactgagaaccagggagaagcaatcctcccggatattgcgcaggcagtgaaagcaaagatggcagaaaagaaactggtgaaggaacagatcatcggacttggaatggggcttccggcaccggtaaccgaggatggaattgttcagaatacagcaaatcttggatggggatacaaagaagtgacacgtgaactggaagagcttcttgacggaatgaaagtgattccggggaatgatgcaaatgtagctgcgcttggtgagatgtggaaaggtggcggaaaaggtcacaagaatgttattatggttacccttggaaccggtgttggcggtggaatcatcgtggatggaaagtgccttgtaggggcacacggtgctggcggagagatcggtcatctgtgtgtaaactaccaggagacagaaacctgtggatgtggaaagaaaggctgtctggaacagtatgcttctgcaacaggaattacaagacttgccaatatgcgtcttgcaaaagatgagaaaccaagtaccctcagaaatgtggcagagatgtctgcgaaagaagtgtttgatgcagtgaaagccggagacgaagttgcaattgaaatcgcaactgaatttggaaagtatctgggacatgcgctggcgaaccttgcagctgcatgtgatccggcggttatcgtaatcggcggaggggtatcaaaagccggagaggttctgctggattacatcaaaggaccatttaaagaaatggcattctttgcagataaagatacagaatttgcacttgcagagcttgcaaatgatgcaggaatctgcggagcagcaaaactggtactgaaataagtgaaagatattataaaaaaacaaaaatcttgtgagaaatatttaacattcttgcaagatttttgttttttatagaagaaaatgcagaatgacaaatgtttacatttgacattctgcacaaaatgatgtagacttatcgtagtaacattattaaataagcctatgaactctaaaaaattgtgaaaaggaaaacaaaatgataatacgtaaaacattaagagagcaagtagttgaaattttaagacataagattttatcaggagagatcaaaccgggagaacgaattatagaggcaaaagtagcagaagagctgaaagtcagcagaggtcctttaagagaagctctcaggcagatcgaagaagaagggctggttgtatatgaagcacagaaaggctgcgtagtaaagacgatgacttatgaagagatgcaggaaacatacctgatccagtctacgcttgagaaactggcagtgcagatgtgcgggggagagatcagcaaagaacagggtgaagagatgcagaagcttgttctttccatggagaaagcggccaatcagaaaaatctgtatgatgttataaaattcgatgaacagttccatgaatgtattgtgaagaccgcacacagtgaaaaacttcatagaatctggaaaatactggaaggagggaatacggcggcatattatacgatggatacaaaaactctggtaccatttgatgtggtccacatcaatcatcagagaattttggatctgtttcataaagggacagtcgaagatatctgtaaagagatagaattacactacatggttgtcccgcatgttctatatgaaaatcaaaagaaaaaaggagaaaggaactgaaggtatggttaaatttattgggaaaaggctggcatatgctgttttgacattgttcttgattacgacagcgacatttttcttggtagcaggtgctcccggagatccaatcgctgcgaaggtcggtcagatgcctgaacaggcacagcagattatccgtgagaaatacggactcgatcagccggtagtaaaacggtatacaacttatatgaagaaccttcttacaacaggagatttcggagaatctattatttataccggtcagtcagcaaatgacattattaaaaacaatacgctggtatcagcgaagataggtttgttgggactactcttccagacaacgattggtatatgtctcggaatggtagcggctcttaacagggggaaaccggtggatcatgtcataagggtactcgttgtattagctatatgtgttcctagtttcgtatttgcatctgtattgcagtattttctggcatttaagtggaaactggtgccggtattcggctggggacaaatgaaacattatattcttccggttgccgcatatgcgatcggcggtatcgcatcttatacaaaatatatgagaagcagtaccttatctgttatcggagaagattatattattacagcaaaagcaaagggatgtacaaagaagagagttgtacggaaacatgttttgagaaatgcaatgcttcctatcattactatgatcggaccttctctggcaggaatttttgcaggatcattcatccttgaacgtatgtttgcgattccgggacttggattctactatgtaaaagcagtttcggataatgattatacgatggtaatcggtcttacaattttctttgctattttgttcgttggctcgctgattgtcgtagacattctgtatggaatcgtcgatccgagaatccgagttgcaaaaggtaagaaataggagggcttctgatgagtacaaaagaggtagtaatgacagaagaatggaatgaatcagatgattttaaacgtgttgggacggaaggattatctggtgaagatatcggagagaaatccctgacctattgggcggatgtctggagaagattcagggaaaacaaacttgcaatatttggtcttatattattaggcctgatcgtagtgctcctgtttatcggaccaatggtcacaggacaggattatcagctgatcgatgcgtcgatcaagaatcagggaccaagcagtgcacactggtttggtacagatgatatgggaagagatctctttacccgtgtctgtgtaggtggacgtatttcaatttatattggtttatgttgtacattggtaatgtttgtgatcggagcacttcttggagcgctggcaggattaaaaggcggactggtagatgacatcatcatgcgtatctgcgaatttatcggaaacctgccatatctgatcattgtagtaattttatccatggtacttggaagaagtatgttctcccttgtttttgcaatgagccttaccgcgtgggtaggaaccgcgcgtatggtaagaggacagatccttcagatcaaggaacaggattatgtgcaggcagcaacagcacttggtgcatcaaccggacgtattattgtcaaacatcttcttccgaatacacttggaattattatggttgatatcacgatgtcagttccgggatttattttcagtgaggctttcttaagttatatcggacttggagtaagaccaccggaaaccagctggggagcacttgcatcagcaggacagcagcagcttatgttttacccacatgaattgttcttcccatgtctgatgatcgtacttacaatgctgactttccatctgatcggtgatggactttcagatgcattggatccgaagctgagaaaataaaagggggaactacaagatgaaagaaaaaatactggaagtgaaaaacctggaggtatctttcaagacctatgccggaatctcacatgcagtaagaggaattgattttaatctgcataaaggagaaactcttgcgattgtaggagagtctggctgtggtaagacagtatcttcaaaagcaatcatgcgattgcttccagaatcgaacacaataataggtgaaaactctgaagtattgttccacggggaagatcttctgaaaaagtcagaaaatgaaatggtttccattcgaggaagcaagatttcaatgattttccaggatccaatgacttcactgaatccgaccatgaagatcggagatcagattgcagaaagtattctgatccatagacagatttctaaagaagaagcatataaagaagctttagaaatgctgcagctggttaaaataccaaatgcagaaaaacgaatgaaacagtatccgtttgaattttcaggcggtatgagacagagagcgatgatcgcaatcgcacttgcatgtaaaccggagatcctgattgcggatgagccgacaactgctctggacgtaaccattcaggcacagattatggaactgatcggagaactgcaaaaagaactggatatggcgatgatcctcgtaacccatgacttaggtgttgtagcgagtgttgcagataagattcaggtgatgtatgcaggaaaaattgtagaacgtggtgatgtacgagagattttctatcagtctacacatccttatacgagagctcttctggattccgttccgaagattcattctacaaacaaagaaacattatattccttaaaaggaacgccgccggatcttatcaatccgccggttggatgttcttttgctccgcgttgtgagtatggaatgaatatctgcagaaagaaatatccggagcttacaaaattcagtgatacacaggaatgcaactgctggcttcatgatccaagagcggatgtgagcaatcttcctgagaatatgataaggaggagacagtaaccatggataaaaaagaagtactgatcgaagtgaaagacctgaagaaatattttcaggttggaagaaaccagacactgaaggcagtggatggggtaaactttaagatctataaaggtgagactcttggaatcgtaggagaatccggctgtggtaaaacaacctgtggaaagacagttatggggctttacaaggctacaggcggtgaagttctttttgacggagttgatattaataaactgaataaaaatgaaaagaaagagtttacaaagagagctcagattattttccaggatccatattcttcactgaatccgagaatgacagtcggtgacatcatcggggaaggaattgacattcacaagctttataccggaaaagaacgccaggaaaagatttatgaattactggaactggtcggacttaaccgagaacatgcgcttcgtttccctcatgaattctcaggcggacaaagacagcgtattggaatcgcaagagcacttgctatcgaaccagaattcatcgtttgcgatgagccgatttcagctcttgacgtttccattcaggcacaggttgtcaacctgctgatcgaacttcagcagaagaaaaacctgacctatctctttatcgcacatgacctgtctatggtaaaacatatttcagaccgtgtcggtgtaatgtatctgggaaatatggttgaatttgcagagagtgatgaattatatcagaatccacttcatccatatacaaaagcgttgatggcagcgattccgatcccggatccggacacagaagaacagaagaagagaattcgactcgagggagagatcccaagcccggttaatccaaaacctggatgcagatttgtgacgagatgcagatatgcaacagaaaaatgtcatcaggagacaccgcagcttgaagaactcaaaccggaacactttgtagcttgtcatagagcaaaagagttgatggaagatcacccgcaagagtaatcttgctggatataaaggaggaagactatgaaaaaaagaaaaacattagcgatgggactcgcagtagcaatggcagtcagctgtcttgccggatgtggcggagatgacaaaaaagctagttctgacggaaaaacagaacaggttctgaatatctccaacaacagtgtggttgtcggactgaacccgctgatcaacacaactggcccggataactcagcatttaacatggtattggatccactcgttaaaagagtaactcaggaaggaaatacctataaaatcgtgcctgctgcagcagagagctgggatatcagtgaagatggacttacttatactttccacatgaacaaagatgcgaagtggagcgatggaacgaaagtaactgcaaatgactttgaatttactttccagaagatggcaactccatccgttgcagcaacaaatgcatggctgtttgatggaattatcgagaacttctcagaagctctttacgatcagggaaagaaaccggaagaaatcggtgtacatgccattgatgaagatacactggaaatcaaaattatccacccggcatcttacttcctggaactggtttcctcatcagcttatccggtaaacaaagcaatgtatgaaaaactcggaagcgactatgcaacatcagaaacaaagactgtatttaacggacctttcaagattgaaagctggagtcagaatacagagatggtattggtaagaaatgatcagtactggggagccgacgatgtgaagcttgacaagatcaatagcaagatcattcaggaatcaggtactgcagttcagtcttatatcaacggtgaactggatgtgatcggtacaacggatgcaaactggggaaagactatcgaagaacagggagaatctgaatcttatcaggttccggatagtgcaccggaattcttcatgctgaatgcagcaaacgaatatctgtgcaatgaaaagatcagacaggctttatcagtagcttatgaccgtcaggaaatgatcgatactcttcgtaatggaaaaggtgttccgatttattctatgatgccagataccattcaggttggggaaaaaacatacacagaattagttggcggaaagaaccatttcgttcaggaacttcaggatgaaatcaaagatccgaaagctttacttattgaagggttaaaagaacttggtaaagatccagacccgtcaaaagtgacaatccgttatgcaagccgtggtacatctgaagtatctaaaaagattgctgaatggatgaaacagcagtgggaaagcgttcttggaatcaatatcgaaatcgatatgatggaatggaacatcatgtgggataagattgacgccggtgattacgatatcgcaacaggcggctggggaccatactacaatgaaccaagtgctcttcttcagttattcgatccggataatggatatttcaacgcagaaaagacaggatggtctggagaagatcctaagaaatatcaggaacttctgaatgaagcaaaatttgaagttgatgaccagaagaaggcagagctttatctgcaggcagaagaactggttgttaagtcaggactgatcgaacctacttatgttgaagaagcacctacatttgttaagaaatatgtgaagaactacttcgtttctacagttggtcaggttgatttctcaaaggtttatattgaaaaatagcatgtcttttagagatataaattaaacaaaaatgtcatagaggttgcaaaacctctatggcactttaaggtgaaaaataaaagtaaatggagaaatgattatgtatgtaattaaaaatggaaccattcataccggaacgggtgaagtgctcgaaaactatgatatcttaatcgaggggaaaaagattaagaaaatcgaaaagaatatttgcgaagcggatgcagaaattattgatgcaaccggaaaacaggttttcccgggtttcatcgatccacattcttctatcggagctatggggattccgactcgttacagagataatgcagaaactacaaatgtaatcaatccggatctgagcgtgaagtatgccatcgatccagatgaagtgaatgcacaggaattctacaaatcaggaattacatctgttggattttcaccggatcacagcaatgtgatcggaggacagattacagtgtgtaagacagctccggatcatatggcaaaccgtattgtaaaagagcacgcagcaatgaaggggagcgtatgctcaaccgttaaggatgtatatggtgcaagtaaccagatgccgaaaacaagaatgggaattttccatttgctcaaagaagcaatcagaaaagatgaccttttgaagaaatatcagatgccatttgtcatcgctgcagaaactgcaggtgagattcagtgtcttatggagcttctgaaagatgaagatatccagcttacaatcgtagatggatttgaattcggcgatgcgattgaagaactgaaagaaaagaaagttggaattatctttggtaatttcagcaatctgtcacagatttccaaacatgaaatcgacctttccagattaaaagaactggtagaaaacggaaaccgcatcgcatttacaaacacatgcaaaggtgcttctgaaggtagagaagtattcatctggagtgcaatcgaagtatatcgtgcaggaatcgatgccgaggatgtagtaaaaatgatgacgatccagccagccgagatgcttggtgttgcagatcagatcggaagtatcgaagttggaaaagacgcggacatcacaatttacagtgatcatcctgtaaaatcttatgcggcacacgtacagttttgtatgataaatggaaaggtggtattatcgtaatgcagacattaatcaaaaatggtattttgtatacaatgacagaggataagggcatctttcagggggatattctcgtcgaaggaacaaagatcaaagaagtagcagaacatatcagtgaagactgcttagaggatggagataagctcattgaggcagaaggatattatgttcttccgggacttatcgatgcacattctcacatcggattatttgatttcaatgtggatccgggtgtagacgatgccaatgagatgacaaatccggttactctttctgttgatgcacgttttggaacaaatccaaaagcaagagaatttaaagtagcttatgagcacggaatcacaaccatgcttctgactccgggaagcggaaatgtattttgcggacttccgtttgcacttaaaacttatggaaacaatgtgtttgatatgacaatcaaatctccatgtgctgtaaagattgctcttggcggtaatccgaaaaatacatacggagatcagagaagacttccgatgacaagaatgggaatcgctaaggttctggatgatacctttgcaaaagcaaagaaatacatggaagacaaagaacagaataaagaagtggagtatgatccggatatggaagctctttgcctggctttaaaaggagaaattccatgtaagatccactgtacacagtatgatatgctcacagcaatcgagattgcgaaaaaatacaacgtacacttctcattagaacatgcatggggagcaaccgattatctggatgaaatcgtggaaagcggatgcgatatatgctacggaccgattgcaacttaccgtagccctggagaacgtagaaaaatcgatgtggaagctgtaaaaatgctggatgacagaggggtgaatgtggcgatgatcactgattcaccgattctgagtgaagaatccctgtatcatcatgtgggagaagcagtgcgtgaaggacttgcacaggagagagcagtaagaacggttacgattaatgctgcaaaagtgctgggcgtagaagaccgtctgggaagcctggaagaaggaaaagatgcagatattattgtaatgaaaggaaaactcggacttgataccgatgcgatggtatactatacgatgattgaaggtaagatcgtatatcagaaatagaaaccagattgatagataaaaaaggggatgtgaaaaaactcgattgagtttttttacatctccctttttgtgcctgttgtgtataaatgactgaaatcatgcgcaaagaaagcgcacttcccctaccccatagaaattctttttttgaatctatgcggcagttctgtttctcatcttttttttctgatatttatgtagattgtggcctatcgccacgagtaaaacttccagtttgactgaatgaatacctcttcggacaattctcttgtaccaacggtcgtttttcataattccgaaagtgccttctgcttgtatcgaacggttcattcgtaataacgcaccgtggatactttctaggttttcgattacttcctgatgcatggaagttaattcctgattgatccgaacggttcgattcttatctgtcttcttacatttctctgcatatggacatccactacagtcttcacattcatacaattcttccttacgtccgtattgatttcccctcacattttttctgtataaaaaatggaatgctttatcgttaggacatctcatgacaccttgctcatcaattctgaagttaactgcacgaaatggatcttcatgatatttctgatccttagtttcctttttaaacattggaaatttcatatacttttcaattccgttctgttcacagaaaatataattgttgtatgagccatatccagcatctgccacaggatatttgggatagaatccataagtttgtttgaagtgctccatcaaaggaacgaaacaatccatatccgaacgataatggttcacgtcaacaactgcaatatattcatctgctacaccaatctgtacattatatgctggcagaagctgatcattgcccatgtaatccgttttgatacgcataaaggtagctgagttatctgttttagagtaactgtttcgattaggaccacagatttcaattttttgtatgtattcttgaagtttctgacagaaagtagtcaagtgttcataatgacgctgttctttggattttcgctttccacttccgtaaacaaatgtacttgtatccagttcccataaaagtactagctgctcaacgatttcattcagataatccggtacatactccggatttgttgtgatctgcaccccgctccatgcgatttctgcattaatctcctcaatctccgcagtgattttttcgtaaagcttgtaacggaacttttcggtagccttcttccatacccaggtatacttgtttgcgtttgcttcaaacttggagccgtcgatgtagagatgttgcagatctacatgctcatcgttaaagatagcatgattgatgtcgttaaaaatgttttcaatcttatcttgaagtatttcattgatgaaatatccaaaggttctgtatgacggagtctgatgatccatgagatacatgaacctgatattaactttgcagttgtcttccagttctctcagagagcagtagccgctagtcataaatccgaaaagtactgtttttaacatgttgactggattatatctgagtcgtccggttgtgtactccggaatatccgtcagatacttgtttaaatcgattcctcccatcaatctgtcaaatgttaaaacaggatccagcagatccaaacaatctgaaagaaacagtggtaaatatccttgttttgaattacaataattattgtgtaaagttttcatcgcaagttaattttaccacaaaaataggacctttcgcatgaacgaatggtcctatttcttttaggaacttatttcacagcccctttttctaattggatgatagattcttactgtccattgccagaatctgagccgccggtattgccggaatcagtgccgccaccggtattaccggaatcgccaccggtattaccggaatcgccaccagtattaccggaatcgccaccggtattaccagaattgccactattattaccggaatcagtgccgccgccggtattgccggaatcactgccggtaccaccggtagtatccccattagtgccggtagagttaccggaggagtttccacccgttgtactattagaatcggatttgtcattcgaattttttgtactgtttgtggtagttgacttgcttgcatgtccggaacatgtctcggttgggacagtatccggatcaaaccattcggtctgtgacggacagccggaaccggcaagtttaccggaaattgtacatacgctcttctgaacgagagaacttggcatctcgaagtctttgtaggtaagtcccaaagcttcatcgatccggttcatgatcttagcccagatcttgaaatgatagttccagcttccttcagacatttcctggttaccatcgtaacccatccagataccacaggtataatacggtgtaaatccttcgaaccagaagtcacggttgtcggaggttgtaccggatttaccggatgcaggcatattattgagctgtgcatcggttgcagtaccctttgtgacaacatcctgcatggcgttggtaagaagtgctgcagttgtatctttgatcacagtgtggctttccggattggagttgtcgatcaggacattaccatcatgatccaatacctttgtgtacagggatggtttgttatatacaccgccgtttgcaatggatgcataggctgctgtcagttcatagttgtaaacaccatgggaaataccaccaagagcaagagactctacagcatcgtcttcggtaagtgtggaaagaccaaatttctcgcagtattcaaaaccaagattgataccaatcttattcaatgtctttaccgcaatgatgttcatggactgttcgattgcctgacggtatgttacggtacctttatagtaatcgccccaccagttatgaacctgatgatgttccaggtcgtgctgatagtagtattcttcatcaacttcggtggtagcaagtgtaagatctgcgctgtccaatgccggagcgtatacggcaagaatcttgaatgtagaacctgcgttacgggtagaacccttgtatgcgcggttcagtccacggttggttgtcttttgtccacggccaccgacaagagctttgatctgccctgttttctgatcgatgatggtcagtgaagtctgcggctgtggagagaggttgacatactcatcataggtctcgccatcctggagaagactgttacggaatgcgtcaattctttcctgtgcagcttcctgtgatccgaagagaagtccttcatcatcaccgtactgatctgccccgaattgtttcaggtgtccggcactgtagttatctaccgagccatcagtatgatagactgtgagggcataatcaacaccccagtcaatattggccggataattgttgtcatcattcaattcttcatcacagatgttctgcatcgtaagattctgagttgaataaatggtgagaccaccgctgtacagtgcgttctctgcctgtgtctgggaatatccaagtccgtcttctgaggtgagatcttcgatcagctgctcagacagggcatcaacaaaataagagttgacggtgttggtctcttcgatccgtgtatttacgttctgaattctggaatatacgtcatctgccagtgcctcatcatgggcagcctggtcgatccagccctgatcgagcatattatccagaacttttttgcggcgggttgcgttgtcttccggattggtgatcggattgtatcttcccggattctgtgtgattgcagcgatggttgcagattcggaaaggttaagttcattgacatccttattaaaatatctctgtgcggctgactgtactcccagacagtcctgaccaaggttgatcgtgttcaggtagctttcaaggattgaatctttatcaagctgcttttcaacctgaattgcgagatactgttcctggatcttacgttccagcttttcttcaaaagtgctttcatttacaaagtcagggaagacattgttcttgatcagctgctgggtaatggtactggctccttcagagaagttgccaccatgagtgataccaacaacaaaagcacggataataccttggatatcaacaccgttatgcttgtaaaaacgggagtcttcgattgcgacgaatgcatgctgcagatcctccgggatctgatcaatcgtcttatatacacggttggcacctgcaccggtgaattcggctattgttgtcgtgccgtcatctgcaagtgcggtggacgtataaccctgtggtttgatgctgtcagctgtaatctcaggtgcattatcaatcacatgcttgatgataaagccacctccgatcgctgcgaggatacagcagacaaagatacataatagaaaacctttaaaaaggcgaacgcccagtttctttttgtgcatattctttttcgatgttatgcgtttttgttttttagaagcttttcgctttccataattcatgaatgcttcctccttcatattgcaatattatatcaaacttgataatctaaataaaggaaaaattgaaaacttcaatgttccattttacaaaattaagaaaaatttcggaaatatagggaaattgtaacatttttgtaattttcttgcatctgaagaaatagatttgtatactgggaatagtgaaaatataaggaaaatgaagggaaaaacgcagacatgcaggaagaatacaaaacagtataccggggaggagaaggggaaattgttgaaaagaaatcccgttttatcgcaacggtaagaccggtacactcagaagaagaagtactggcatttatagaagaagtgaagaaaaaatactgggacgcaagacataactgttttgcttatgtgatcggtgtaacaaatccaactctgagatgtagtgatgacggggagcctgcaggtacagcaggaaaaccgatgctggatgtgcttacaggggaaggtcttcacgatacggcggttgttgtgaccaggtattttggcgggacgcttctgggaacaggtggtctggtgcgggcttatcagggagcagtaaaggaaggtcttcaggcaagtactgtgatcacaaagcgcctgggttaccggtatgagattggaacggattataccggacttgggaagatccagtatatcctcggacaacggcagatcagtgtgcaggatacacagtatacggataaagtgctgatgaaagtgattctgccttatgatcaggagcaatgtgtggtttccgagattacagagggaacaaatggacaggctgtgatcgaaaaaggagacagctgctattttgcggaggatggaaaagaaatcctggtttttgaggaatagaacaggaaaaagaacccctatacagaacggagaatccgttctgtataggggttttaatgtcttagtatacaggaggaactgcagacagcaggttctctgtatgagcttattggtttactggaattccggttcgatcagaccgtaggttccattctttctcttatatacgacattgacttcgtctgtctcagcattgctgaatacgtagaagttatgtccgagaagttccatctgaatgcaggcatcctccgggaacattggtttgatgccgaaacgtttggtacggacgatctcaatctcgtctgactctgctgccgaagtatcggattcaataaattcctgacggaaatcatgtccgccctgctgttttgcaatcagtttggttttatactttctgagctgacgctcgataatttcttctacgagatcaatggatacatacatatcgctgctttcctgctcggaacggataatgtttccttttacagggatcgtaacttcgattttctgacgttctttttctacactgagtgtaacgataatgtcagtttcaggagtaaaatacttttccagttttcctaatttctgttctacagcctgtctgagaccaggtgtgatgtcaatgtttcttccgctaatgataaaattcatacagctcaactccttttttctcatatttctcatagtatgtacggagataagtgcatctataagagcttgaccggcaggatgtatagatagtttttatatccttccggctatagctacattatactctatcataggggagagatgcaatggtaaatgcaaaaaaattattaaaattctgtaaagaaaactgaattatcagaaaattctgtcaatgtatggagcggattacttcgatacgactgatcttgccgttatgcattttggcaacgcgcagaccaaaattgtcgaagaatgtacttgcaccaacaccaatttctgttttttcctgttcaaatcttttagtgatcacgtcatataaggtttgttcatcttcatacggaatatggacgtgcaggatgctgtttacaatccgtgcttttgtagtagcacggaaaatgattttttcagattcatcaaattcaataaaaaggaactttctggttgcaaataaaagtgcgatggagatcacaccgatcaggctggataccggattattatgtgccatgatcacctgtctggcgatggcaaataacagcacctcaaacacagtggaaggcttgtgctgataaagcatacggatcagctcgacaccaatgatcagattgaaacaggtttctaccaggtcttcgtaatttggataaatattcagatccggaacatttggcatggacaggatcagctggacaagcagaatgatgattccggcagccagaacgaatgaaatgataaattccagaagtacggtcagcttatggagtgctgcgtttaagtattttttcataaaaaatcccccttgttcgttgtatacaaagattgtaacggatacaagggggaagtgtaaagaaaaatctatagttttttactggaaattgcttctcttacggagtttcggatccagaatctttttacggatacgcaggctcttcggtgtgacttccagaagttcatcggtatcgatgaaatcaagtgcttcttccagactgaggattctcggcggagtaagctttaaggcttcatcagcacttgaagaacgggtattggtaaggtgtttggtcttacatacattcagttcgatatcatctgtcttcgcattctgaccgattaccataccggagtaaaccttttcaccaggtccgatgaagagtgttccacgatcctgtgcgttgaacagaccgtaagctacagcttcacctgtctcgaaggcgatcagggatccctggcttctgtactggatatctcctttatacggagcgtagcagtcaaaggctgtgttcatgataccgttaccttttgtatcggtcaggaattctccacgataaccgatcagacctcttgacgggatggagaattcaagacgggtgtatccgccattagacattcccatgttgcggagttcgccttttctctggcttaatttatcaataactatacctgtaaattcatccggtacatcaatgtatacggtttccattggctcgagctgcttgccgttttcgtcttttttgtaaagaacttcggctttgctgactgcgaattcataaccttcacgacgcatgttttcaacgaggacggaaagatgaagctctccacgtccggataccttgaagctgtctgtgttgtctgtctcttcaacacgaaggctgacgtctgtattcagttcacggaacagacggtcacggaggtgacgggaagtgacgaatttaccctcctgtcctgcaaacggactgtcgttgacaccgaactgcattgcgatcgtaggctcggaaatcttctggaattcgatcggaaccggattgtccggcgaacagatcgtatcaccgatggaaatatctgcaataccggagattgcaacgatagaaccgatgcctgcttcttttacttctactttattcagaccgtcaaattcatataatttgctgatctttacttttttctgtttgtccggatcatgatggtttacaacaactacatcctggttgacagaaatcgttccgttatcgacttttccaacaccgatacggccaacgtattcattgtaatcgatggtgctgatcagcatctgtgtacctgcatcaggatctccttccggagccgggatgtaatccaggatggtctcaaacagaggaaccatgtctttcggttcatcgtcgatattgtaagttgcatatccgtctcttgcagaagcaaaaaggaacgggcagtcaagctgttcgtcagatgcgcccagatcgatgagaagttcaagaacttcatcgataacttcatccggacgtgcttccggacggtcgatcttgttgatacatacgataaccgggagcttcagtgcaagagcttttttcaaaacaaatttggtctgtggcatggcaccttcaaaagcgtcaaccagaagaaccactccattgaccatcttaaggacacgttctacttctccgccgaaatcggcatgtccaggagtgtcaatgatattgatctttgtatttttataaacaactgcagtgtttttggaaagaatggtaattccacgttcacgttcgatatcgttggaatccattactcgttcggctacttcctgattttcacggaaaacaccgctctgttttaaaagttcatctactaatgttgttttaccatgatcaacatgggcgatgatagcaatatttctaatgtcttcacgttttgtcttcatattctcaaaacccttcttattacctatttaaagttacaacccgtatagtttatcacattttgaaaaatttacaagtagaaagaaaaaaatttgactttctgcaaaaaaagaggttactttttgttctaaaaactggaaaagcttcatagattagatagtgatcaagagtaagaacgcggtaaaatacgcctgcgaagaggaaggagatttacattattatgtcagataagattattgaaaataaccaggtaacgatcatgggaaaggtagcaactgaattttcattcagccatgaggtcttcggagaaggcttttatatggtagaggtagaagtgaaaagactgagcaattcagaagaccgtattccgctgatgatctcagagaggctgatcgacgtgacacaggattataccggagagtatattatggtgcacggacagttccgctcttacaatcggcatgaagagcagaaaaaccgtctggtattatccgtatttgtacgggagatttcctttatggaagaagaacctgacgggacaaagaccaacagtatctggctggatggctatatctgcaaggaaccgatctaccggaagacaccgcttggaagggagatcgcagatcttttgcttgcggttaaccgcccatatggaaaatctgattacattccatgtatctgctgggggagaaatgcaagatatgcctccggctttgaagtgggagagcatgtacagcttctgggaaggatccagagcagggaatatgtaaaacggatttcagataccgagacagaaaagagggttgcttatgaagtttcggtcagtaaactggaaaagactctgattgacagtgcctgcatttaatgctaaacttgatttgatcgtttagtatcataaagcaacatgtcaggaggaatattatggctatatttacaggatcaggagtggcacttgtaacgccgtttcatgaggacgagagtataaattatgacaaactggatgaaatgctggactaccattgtacacatgggaccgacagtattatcatctgcggaacaacaggtgaatcctctactttatcagaagaagagcacatggaatgcatcaaatttgcgatcgagcgtgtcaagggaagaatcccggtgatcgcaggtaccggttccaacagtacctacacaacgatccagatgtcaaaagaggcagtagaagacggtgcagacggactgctgcttgtaacaccatattataacaaatgtacacaggacggactgatcgcacattataccgctgttgcaaaagaagcaaaagcaccaattatcctttacagtgtggcgagccgtaccggtgtgaatattgctccggagacagttgcagctttacataaaaatatagagaatattgttgcggtaaaagaagcatcaggcaatatttcccagatttcaaagatcatgcagctgacagatggcaagatcgatctgtattcaggcaatgatgaccagatcgtaccgctcctttctgttggaggaaagggtgtcatctcagttcttgcgaacgtggctccgcagtatacacatgacatctgtgcaaagttctttgaaggagatgtcaagggaagctgtaagatgcagctggatgcgattccgctgatcgagaagttattctgtgaagtgaatccgattccggttaaaaaggctttaaatctgatgggatggcaggcaggtcctctgcgtatgcctctgacagagatgacagaagcacatacagcacagcttgcaaaagaactggaagcatttggaattaaactggcataataaagggtcagattatagagaaaagggactgactggagtatccatcagttccttttgtgctatacaggaatttgtgaaaagatacacaagaaaatggagataacaaggaggaatacaaaatggttaaggcaattatgcatggatgtaacggaaaaatgggacaggtgatctcgggacttgtaaaggaggatgatgtgatcgagatcgtggcaggtattgataaattcaccggaatcgagaatccgtacccggtatttacaagccttgcagagtgtgatgtgcaggcagatgttgtgattgatttctcaaacgcagcagcagttgatgagctcctggatgtatgtgtggagaaaactcttccggttgttctttgcacaacaggactttctgaggaacagcttgcaaaggtgaaagaagcaggagaaaaagttgcggttctccgttctgcaaacatgtcactgggagtcaatcttctgatgaagcttttaaaggatgcagcaaaggttcttgctccggcaggctttgatattgaaattgtagaaaaacatcataatcagaaagttgatgctccaagtggaacagcgatcgcacttgcagattcgattaatgaagcgatggctgaccagtatgtatacaattatgaccgcagccatgaacgaaaaaaacgtgagaaaaacgaaatcgggatcgttgcagtacgtggaggtacgatcgttggacagcatgacgtcatctttgcgggggcagatgaagtgatcgaattccaccacactgcatattcaaaagcaatttttggaaaaggtgcagttgaagctgccaaattcctggctggaaaaccggcaggaatgtacgatatgagtgatgtgatcggactgtaagcagaaaaagcttttatacaagagggaggaagttatgaaagcattagaggagaaatatctggaagggctgtcggaattatttccatcaatcgcagctgcgtccacagaaattattaacttacaggcaatcgtgaatcttccaaaaggaacggaacattttctgacggatattcacggagaatatgaagcgtttgcacatgtgctgaagaacggatcgggttcggtaaagcgcaaggtcgatgatgtatttgcaaacacaatgagcagtcgggacaagcagacactggcaacattgatctactatccgcgggagaagatggagcggatccgggaagaagaacagaatatggatgactggtacaagatcatgctgtaccgtctgatcgaggtagcaaaacgttcggcgagcaaatataccagatcgaaggtcagaaaagcactcccgaaggattttgcatatgtgatcgaggaactgatcacagaaaagtcaggaatgacagataaggaatcatattataattcgatcatcagtacaattatccagattggaagagcagaggaatttattgtagccttgtgtgaactgatccagcgtctggttgtggatcacctgcatattgtcggtgatatttacgacagaggtccgggaccgcatctgatcatggacaagctgatggagtatcattcggtggacatccagtgggggaatcatgatatcctgtggatgggagcggcagcggggcagaaatgctgtattgcgaatgtaatccgtatctgtgcccgctatgggaatctggatattctggaggatggatatgggatcaatctgcttccgcttgcaactttcgcatggaaacagtatgcaaaagatccctgtgaatgctttttattaaaagggcaggacaactgcaaaccacaggagatggaactgaatatgaaaatgcacaaggcaatttctgttatccagttcaaagtagaaggacaggcagcagagctttatccggaatttggtttccagagaagaaactttctggataagatcaactacgaggaagggactataacgataggaggaaaaatctatcagcttctggatgattattttccgacaatagatccgaagaatccatatcagctttcagctgaagaagaagagatcatgaaccgcctggtaaaagcgttccagagctgtgaaaaattgcagcggcatatgcgtttccttttgaacaaaggaagtctttacaagatttacaattccaatctgctgtatcacggctgtgttccactgaatgatgacggatcactcagaaaggtaaagatatacggtaaaagctatcagggaaggacactttatgatgtgatggagtcctatgtgagaaaaggattttttgcggtagatccggatgaaaagaaaaaagggcgtgacctgatgtggtatatctggcagggtgcgaattctcctcttttcggcaaagataaaatggcgacctttgagcgttatttccttgcagaaaaggagctgtggaaagagaaaaagaatgcgtattatcttcttcttgaagatgaaaatgtgatgaacggaattctggatgaatttggcctggacagagaaatttcccatatcatcaacggacatgttccggtgaaaacgaaaaatggagagaatccggtcaaatgtggtggaaaagtgcttgtaattgatggcggattttcaaaagcgtaccagaaagaaaccggaattgcaggatacacgctgatctataattcctatggactgatccttgcggcgcatgatccgtttgaatcgacggaggcagctattgaaaaagaaagagatatccattcggacagtgtgatcgtaaaacggacactcgaacgcaagacggtaggagatactgatgttggaaaagtactgaaggaacggatcgcggatctggaggcattgctggacgcttacagaagtggtcagatcatcgaaaaaatttaaaaataagtataaaaatcctttttctgcggatagtaatagtacaagtattttacagaaaaaggagaattacaacatgcaatatctaagaagaatggttctggtttttacctgtgtgatgctgatgggaggaattacggcgtgtggaaatggtgataacgctgcaaatccggatacgaataccggtgggacgaatcagaatggaacggtaaatgatgtcacaaacgatatcggagatggtgttgaggatgcagtagatgatgtggaagacggagtcgatgatatgaccagaaacaggacagaggaccggaatgtaaatgataatcatacaatagatggtcaggaatagggaaaaggcaagactttgcggaaaagtcttgccttttttacagacaaaaggtagtaaaatgtccgtgggtgtgatacaatatgacggtatgtaaagacgagatcaacagaaaaagcggaggacttcatgaaatttcgaccatgtatagatattcataacggtgcagtcaagcagattgtgggtggcagcctgaaagatgcgggaaatgcagcggtagaaaattacatatccagacaggatgcagattattatgcgacaaggtataagaaagatggacttaccggaggacacattattttgctgaatccgccggcatcggaatactatgatgcgacaaaggcacaggcactgaaagcactacatgcctatccgggcggaatgcagatcggcggaggaattactgcagaaaatgctgcagagtatctggaggaaggggcaagtcatgtgatcgttacatcctatgtatttcagaatggacaagtgcggtatgaccggctggaccggctgaaaaaggcagtagggaaagagcatctggtactggatctcagctgccggagacgcgagaacagttattatattgtaaccaacagatggcagacatttaccgagctcagactgataccggaggtcctggaagagctgtccggatggtgtgatgaatttctggttcacggggttgatgtagaaggaaaagcatctggtacagaggaggatctggtcaggatgcttgcggcgtggaacggacttccgatcacctatgccggtggaattggaagcatggaggatctgcgggagtttgcacggatcagcggggaaaagctggactatacgatcggcagtgcactggatctttttggcggtaagattccgtatgccgagctgacagaaccggtgaaataaactgattgaagaataaaagaaatggtgctacaatggatactgtctatctatagcggaaaaaagcaaaacacttcagacagaagtgataagcaaggaatataaggagcttaataaaatgggaattattgaaaagatatttggaacgcacagcgaacatgaattgaagcgaatctacccgatcgtggatcatattgatgcgctggagccggagatgcagaagctctccgatgaggaattgaaagaaaagacgaaagaattcaaggagaggcttgcaaaaggagagacactggacgatcttcttccggaagcgtttgctgttgtaagagaggcagctgtccgtgtacttggaatgcgccactaccgtgtacagatgatcgggggtatcatcctgcatcagggccgtattgccgagatgaagaccggtgaaggtaaaacacttgtatctacactgccggcatacttaaatgcactgaccggagaaggggtgcatattgtaacagtcaacgactatctggcaaagcgtgatgctgagtggatgggaaaggttcatgaattcctgggactgactgttggagttgttctgaaccagatggataatgatgaacgacgtgcagcgtataattgcgatatcacttatgtgacgaataatgaacttggtttcgattacctccgtgataacatggttatctacaaagaacagctggtacagcgcggtatgaaatatgcacttatcgatgaggttgactcagttctgatcgatgaagcgagaacaccgcttatcatttccggacagagtggaaagtcaaccagactttacgaagcatgtgatgttctggcaagacagctggagagaggtgaagcaagcggggaattctctaagatgaacgccattatgggagaagagatcgaagagaccggagacttcattgtcaatgaaaaagaaaagaatatcaacctgaccgaagagggtgtgaagaaggttgagaagttcttccatattgagaaccttgctgacccggagaacctggagatccagcacaacatcattttggcactgcgtgcacataatctgatgttccgtgaccaggattatgtagtaaaagatgatgaggtcctgatcgttgatgaatttaccggacgtatcatgccgggacgccgttattctgacggacttcatcaggcaatcgaagcaaaagagcatgtaaaggtcaagagagaaagcaagactctggctaccattacattccagaatttgtttaataaatatgagaagaaatccggtatgacaggtacagccctcacagaggaacaggagttccgtgatatttacggaatggacgttattgagattccgacgaatgttccggtacagagaattgacctggaggatgccgtttacaaatcaaagaaagagaaatttaacgcggttattgatgcaatctgtgaagcgcatgaaaaagaacagccggttctggttggtacgatcacgatcgaaacttccgagctcctcagtaagatgctcagtaaacgcggcgtaaaacataatgtactgaatgccaagttccatgaactggaggctgagatcgttgcacaggcaggacagcatggggctgttacgatcgcaaccaacatggcaggccgtggtacggatatcaagcttgatgaagaatcaagagcagccggcggactgaagatcatcggtacagaacgtcatgaatcccgtcgtattgacaaccagttgcgtggacgtgccggacgtcagggcgatccgggagaatccagattctatatttctctggaggatgacctgatgcgtctgttcggttccgagagactgatggatgtatttaccaagcttggagtagaagaaggagaacagatcgagcacaagatgctttcaagtgcgattgagaaggctcagaagaagattgagagcaataactttggtattcgtaagaacctgcttgaatatgaccaggtaatgaatgaacagagagagatcatctacgatgaaagacgcagagtccttgacggtgagaatatgagagattctatcttccatatgatcacagactttgtggaaaatactgtcgatgccaatctttctgaggaacaggattttgaagaatgggatcttggagcaatgaaccgtgaacttctggatgtgattccaacgcttccgccggttacggaggaggatgcaaaggataaagagccaaaagagatcaagcatctcctgaaagaacgtgctgcaaaagcatacgaagaaaaagaagcacagttcccggaagcagagcatctgcgtgaggtggagcgtgtgttccttctgcgtgtgatcgatgcaaaatggatggatcacattgatgatatggatcagttacgtcagggaatcggtctgcaggcttacggacagagagatcctctggttgaatacaagatgatcggatatgatatgttcggtgaaatgacacgtgcaatcgaagtggatacagtcagacttctcttccatgtcaatgtagaacagaaggttgaaagagaacaggttgcaaaggtaaccggtaccaataaagatgacagtgttgcaaagggtccaaaggtacgtgccgagaaaaagatatatccaaatgatccatgcccgtgtggaagcggcaagaaatacaaacagtgctgtggaagaaaataaatacgactgtttggatttttatataattttatgagatttgaggtgatacagtggttgaattagacggatttaagcagacattaaatgcgtatgaagaacccctgaaggaaatgagggattcactttgacctggcaggcaaagaaaaacggattgaagagctggaaagaaagatagaagaaccggggttctgggacaagacagagctttcgcagaggattatgaaggaactccggaaaatgcaggactgtgtgaaggaggtccgggatctggaaagttcatatgaagatatcaatgcactgatcgaacttacggaagaggaagaagaccgggagatgatcaaagagatccagcgtgagatcgctaaatttgaaaaagaatttgaagatctcaggatccggacgcttctttcgggagaatatgattcctgcaatgcaatcgtgacattgcatgcaggagccggaggaacagacagctgtgactgggcaaatatgctgtatcgtatgtatacaagatatgcacagtcaaaaggatttcagataaccgtgctggactatcaggacggagatattaccggactgaaaggaatcacgtttgaagtaacgggagataatgcatatggctattttcagtcagaaaagggagtgcaccgtctggtgcgtatttctccgttcaattcagcaggcaagaggcagacatcttttgcatcctgtgatgtgataccggatattgaagatgatattgacattgagctgaatgacgacgacctgcggatcgatacctaccgttcgagcggagccggaggacagcatatcaacaagacttcgtctgcggtgcggatcacgcatcttccgacaggaatcgtagtgcagtgccagaatgaacgttcgcagctttttaataaggacaaagcgatgcagatgttgaaagccaagctgtatcttttgaaaaagcaggagcaggaagaaaaggtatccggcatccggggggaagttcaggatatcaattttggaagccagatccgatcctatattttacatccttacaatctggtcaaggatcaccgtaccggtgaagagaccggaaatgtaagtgcagttctggatggggagctggatccatttatcaatgcttatctgaaacagaggagtaacaatggataatacaaagtactatgtggtaaagaaaaaagcagtgccggaggtgctcataaaggttgtcgagacaaagagactgctcgcaaccagacgtggaatgactattcaggaagcgacagaagagatcggtatcagcagaagttctttctataaatataaggatgatattttcccatttcacgaaaatgaaaaaggaaggactgttacgatggttattcagcttgatgatacaccgggggttatggcagagcttttaaacgcggtggcaaggtatcaggcgaatatcctgactattcaccagagtattccgatcaacggggtggcaacactgacgctcagtgtggaggtgttgcagacaacgaagaatctgtcggagatggtggaagagattgaacagcattcaggtgtgcattatttgaaaatcgtaggcagggagtagacaaaaagatgaagattgcagtattgggttatggtaccgtaggttctggtgtggtagaggttctggatgtaaatcagaagctgatcgcgtcacgggcaaaagaagaaattgaagtaaaatatgtgctggatctgagggatttcccgggagataagatccaggaaaagattgttcatgattatgagattatcctgaatgatccggagattggaattgtagtagaagtgatgggcggtgtggaaccggcgaatacctttgtcagaaaagcactggaagcaggaaaaagtgttgtgacatccaataaggcgttggttgccaagcatggatccgcactccttaaaacagcacgggaaaagaatgtgaatttcctttttgaagcaagtgtgggaggggggattccaatcctccgggcacttggatcatccctgacaggtgatgagatcgaagaaatcgcaggaatcctgaacggaacaaccaattacatgatgaccaggatgttctacgagggagcgaactatgaagaggttctccgtgaagcacagaagaatggatttgcagaggcagatccgactgctgatgtggaaggacaggatgcatgccggaagatcgcgatccttgcatcgatcatctcaggaaaatatgtggattttgaagaaatttataccgaaggtattacaaagatcacaacagaagatatgcagtatgcaaaggctctgggaatgaatatcaaacttcttgctgaatgtaagcatgtggacggaactctttatgcgggagttgcaccggtgcttcttcatgcagaacatccgctttacagtgtgaatggtgtatttaatgccgtatttgtaaaggggaatatgctgggagatgcgatgttctacggaagtggggcaggaaagcttccgactgcgagtgcggttgtggctgacattgtggcagttgtacagaatcagggcagagatatcatgaatttctggagcgaagaaaagcttacattggaagacagaagcaagactagcaagaagttcctggtgcgaatccgtggaaatgaggatgcgctcaaagaacgaatcggcaatgattttggtgaagtaagatttgtagaggcaggagtcaatggagaattcggttttgtcacaccggtgatgaccgagggagaatacgaggaaaaagcaaaagcttatccggaaatcctgcatatgataagagtagaagaagaagtctaaaaatgcaggaactgtaggaggaaattatgctggtagttaagaaatttggcggcagttcagttgcagataaagagaggatctttaatgtggcaagacgctgcgcagaagagtatcagatggggaatgatgtgatcgttgttctctctgcaatgggagatacaacagatgaactgcttgagaaggcagccgagatcaatccgtatccatcaaaacgagaacttgatatgctccttaccacgggagagcaggcatctgtggcactgatggcaatggcacttcagtttttgaatgttccggcaatctcgctgaatgcattccaggtaaagatgcattctacggcgcggaacggaaatgcaagatttaaaagagtggatacagaccgtatcacccacgaactggagaaccgtaagatcgtgatcgtaaccggattccagggagtcaaccattatggagactataccacacttggaagaggtggatccgatacgacagctgtggcacttgcggctgcaatgcatgcagacaaatgcgagatttatacagacgtagacggtgtttacactgcagacccgagagtggtaccgaatgcacgcaaaatcgaagagatcacctacgatgagatgctggagcttgcaacatcaggggcaaaggttttacataatcgttctgtagagatggcgaaaaaatacggggttgagctggttgtacgttccagcctgaacacagaagaaggaaccctggtcaaggaggtagcaaaggtggaaaaaatgttaattaccggcgttgcggcagataaaaatacagcgagaatttcagtaatgggtgtagaagacaaaccaggtactgcatttaagattttcaatacacttgcaaaacataatattaacgtagatattattcttcagtcagttggacgtgacggaacaaaagacattacgtttactgtatcacaggatgatcttaaagaggcaatggaagttatggaagccagaaaagaagcccttacgatcaaagagatgaattacaacgaaaaagttgcaaaggtatcgatcgtaggagctggaatgctcagcaatccgggcgttgctgcgaccatgtttgagtcacttagcaattccaatatcaatatcaatatgatttctacatcagagatccgtatcacggttctgatcgatgaaaaagatgcagaccgtgcactggttgcaatccatgacggatttggtctggaagactaataaaaagaatgtggtcgcaaatgtaccggatggagcatttgcggaagaaaaaaggattgggaaatttctcaatcctttttctgactcagtgtactgttatgatatttgctggaaaaggtgacatcctcaccaaaccagtccggcggggtaaaggaatttgcctcttcttcggaagaaaattcgacttcggcaaggagaagaggggagagatcaccggcgaagacgtcaagctcgatcgtgagatgatctccgtaagggatgcagtagcgttcttttgtgataatgcgcccgtctgccttttcgcgcagatggcagtaggcttcctcggtaagaggaagattatgttcttcacgcatcatcagacctttggatttgtaggtcaggatgtagtcatcagcatctctgcggacacggacaaccggttcggtgcatagataagcctgctcaagtgtgcggtgcggataagcttcaaggtgatccggaagcttatgaatcagatatttgcgttcaatttccatgggaaagccctccttatacattcattaacagtatagcggagtttttcaggggagacaaggcagaaagttgccatttttgcaggcttctgttacaatggggaacatcaggaaaaagaaaggatggacaagattatgaatgaagtatgtgtatttcttgcagatggatttgaagagattgaaggtcttacggtcgttgatcttttaagaagagccgggatcgagaccagaaccgtttccatcatgggacaggaagaaatcaagggggcacacggaattatagtaaaagcagacagcttgtttgaaaatacagatttttcagaggtgaagatgctggtgcttccgggggggatgccgggaacaatccatttaaaagaacacaaaggtcttgaagagctgatcctaaaacataatgaagaaaaaaaatatctggctgcaatctgtgcggcaccgaccgtatttggcggaatgggaatcctgaaaggaaagaaggcaatctgctatccgggaatggaagaaggacttaccggagcggaagttacctgtcagccggcagtgacagatggacatatcacaaccagccggggacttggaaccgcgatcgattttgcacttgcgctgatcagcgagctgcgggataaagaaagcgcagataccatttcaaagcaggtaatctatgaacggtagtttctggaaaaagagaaaagcaggcagtgtgtttctggcagtgctgcttttgactacactgcttgccggatgtgggatcaatgaaggaaaggcggaaaaatatgtgcaggcgaacctggatctgacttttcagggacaaacccaggaagcaaaagaaatcctcggagcatcagacagtgatctgaaaaaggtctatgagaacgggatcaatgcttttgtccaggactgtctgctaaatggtgtggagacggaaaatgacttttctgagacatatggtgtattgatcaaagagatctttagttccgcccgttatcaggtaagtggtgtaaaaaagacggggagtaagacctgtgaggtgacggtaaagtaccagccggtggatgtatttacccgcttcatgccgaagctgaaggaagagtccgagaagatccaggcagacaaagatgcaggaaagtacagtggaacagatgaagaaatcaaagaggcaatggtgctggattacatgaccggtgcatacagtcttttaagaagttcttatcttgatatgcagtatggagagaagcaggaatatacctttaccgtgacgcaaaaagggcggaatacctggtcgctcggtgatgaggaattaaatggctttatagaacgaattttagagcttgataaactgtagaagttgtgctatacttgtaaaatgattgtaatgtagataagtctgtcgactttttgcatatgtaaatttaggaggaaatggtaatgagtttacaagttgaacagttagaacacaatatggcgaaactcacaatcgaagtttcagcagaagaattagaaggagcacttcagaaagcataccagaaacagaaaagcagaattaatgttcctggattccgtaaaggaaaagttccgcgccagctcatcgaaaagatgtacggaccggaaatcttctatgatgatgcagcaaacgctctgattccggaagcatattcaaaagcatacgatgaaagcggacttgagatcgtatctcagccgaagatcgatgtaacacagatcgaaaaaggaaaaccgttcatcttcacagctgaagtagctacaaagccggaagtagaacttggcgaatacaaaggaatcgaagttccgaaatattctaaccgcgtaacacagaaagaaatcgacgctaagcttgaggaagaacagcttaagaacgcaagaacaatcacagtagaaggacgtccggtacaggataaagacgaagttgtccttgattttgaaggatttgtagacggagaagcttttgaaggtggaaaaggagaaaactatccgctgacaatcggttcaggatctttcattccaggatttgaagaacagctgatcggtgcagaaccggaaaaagaagttgaagttaaggttacattcccggaagattaccatgcagaagacctcaaaggaaaagaagctgtattcaaatgcacagttcatgagatcaaagcaaaagaacttccggagcttgatgatgaatttgcttcagaagtatcagaattcgatactcttgatgaattaaaaactgatatcaaagctaagatcaaagagcagaaagtaaacgatggcaagagagcacaggaagatgcagctgtagatgcgatcatcgaatcagctaagatggatcttccggaagctatggttgatacacaggcaagacagatgcttgatgaattcgctcagagaatgcagcagcagggactgactcttgaccagtacatgcagttcacaggcatgacagctgacaagatgatggatgaacttcgtccgcaggctgagaagagaatcaagacaagacttgttcttgaagcaattgcaaaagcagaaaacatcgaaatcacagatgaaaaattagacgaagagatcgctaagatggcagaagcttaccagatggaagctgacaaacttaagagctttatgggcgacaaagaaaaagaacagatgaagcaggatatggcagttcaggaagcaattacatttgtagttgacaatgccgtagaaaaataagtatctgtttcatactttaatatagcaggaggagtgttacatgagtagtttagtaccttatgtcgttgaacagacaagccgtggagaacgctcttacgacatttattcaagacttttaaaagacagaatcattttcttggataccgaagtgaatgatgcatcagcgagcctgatcgtagcgcagctgctgtttctggaagcagaagatccggaaaaggatatccagttttacattaacagtcctggcggatcaatttcagcaggtatgtcgatctacgacactatgaattacatcaaatgtgacgtctctacgatgtgtatgggaatggctgcaagtatgggagccttccttctcgcaggcggagcaaagggaaagagatatgcccttccgaatgcagagatcatgattcaccagccttcaggcggtgcacagggtcaggcaactgagattgagatcaatgcacagcatattctgaagatcagagaaagaatgaacagattgatggctgcaaatacaggtcagagttatgagacaatttgtgcagatacggaaagagataactggaagactgccgaagaagctttggcatatggattgattgataaggttattacaagccgttaacgggaaaagggaatgtccttattgggacattccctttacgtgtaaaaaagtgcgaggtaagaatatggcaggaaaatatgaagaaatcgtaagatgttctttttgcaataaaccacagagtcaggtacgcaagatgatcgccggaccaaatggggtgtttatctgtgaccagtgtgtggatgtatgtactgagatcattgaagatgaacttggttatgaagaagaaaatgcatatgatgatatcaatcttctgaaaccggaagaaatcaaggcatttctggatgattatgtgatcggacaggacgaagcaaagaaagtactttctgttgcggtatataatcactataagcgtattatggcagaaaaagatctgggcgtggagcttcagaagagtaatatcctgatggtaggaccgacaggatgtggtaagacttttctggcacagtctctcgcaaaaattctgaatgtaccgtttgcaattgcagatgcaactgcgcttacagaagcgggatatgtcggagaagatgtagagaatattcttcttaagatcattcaggcagcagatggtgatattgaacgtgcagagcacggaatcatttatatcgatgagattgacaaaatcacaagaaaatctgagaatccgtcgattacccgtgatgtatcaggagaaggtgttcagcaggcacttctgaagatcctggaaggtacaatcgcaaatgtaccgccacagggtggacgtaagcatccgcagcaggagatgatccagattgataccaccaatattttatttatctgtggtggagcgtttgagggaatagataagatcatagagaacagaatagataagaaatccattggatttgaggcacagatcgcgcagcggcatgaggaagatatcgaccggcttctgcagcagattcttccacaggatcttgtgaagttcggactgatcccggaacttgtaggacgtgtgccggtaactgtatccctggaacttctggataaggaagatctgatccgcattctgacggaaccaaagaatgcgattgtaaaacagtaccagaagcttctggagctggatgatgtggaactggaattcgacaaagaggcgctggaggcgattgctgagacttccctgaagcgtaagacaggagccagaggactccgtgcgatcatggaaaatgtaatgatggatatcatgtataaagcaccgtctgatgagaatctgaaatactgtcttgtgacaaaagaggcagtacttggggagaaagcaccgagtacagaaaagatcgaagcaagaccggaaagtgcataagaaaatcagacgtatggaaatgggtgctgacggttaaggccagaagcatccatttttatttaacaggagaaaaaactatatgaacagaacagaaagtctgccaatggttgccctgcggggaatgacaattctgccggagatggtggcacattttgacatcagccgggaacgctcgattgaagcggttcaggaagcgatggcaagcaaccagaagatttttttgctgacacagaaagatgtggaagtggaaaatccgggagaagcggatctctaccgtgtgggaacagttgcgacagtaaaacagatcatcaaactgccaaagcagattctgcgggtgcttgtatcagcagaagaacgggcggttttaaatacaatagaatttgcagatccgtatcttcgggcaaatattacgatcccagaagagagtgatccggatattgcaggcgagatcaaccgggaagcgatgacgcggggacttcgggatctgtatctggattatgcggcgagaatgccgaagatcacaaaagatatggtaaaccagatcaaagagatcacggaattgaaaaagatggtgaatcaggtggcagcgaatatgcctctggattaccgggaattgcaggaaatcctggaagaacttgattttgacagacgttatgagcttatttcctttaagttggtcaatgagatgcagatcatgaacatccgcgatgagatccagatgaaggtgaaagagcgtgtggataagcatcagagagaatatatcctgcgcgaacagttgaagctgatccgagaagagcttggtgaggatactacaatttccgatgcggaggaatttgcacagaaggcagaagcgctggatgcaccggatgaggtaaaagaaaagctgaaaaaagagatcagcagatttaaaaattccatgcagagtccggcagaagcgggcgtgatccgtacatatattgaaaccatgctggaaatgccatggaataagcgggccgaggattttacagacattgcatatgcgaaagagcttctggaagcagaacattacggactggaagaggttaaagaacgtgtgctggagtttctggcagtacgtgctcttacgaaaaagggtgacagcccgatcctgtgtctggtaggtcctccgggaactggaaagacatccattgcaagatcacttgcaaaagcactgaaaaaaccgtatgtgagaatttctcttggcggtgtccgtgatgaggctgaaatccgtggacacagaaaaacttatgttggtgcaatgccgggacggatcgcaaacggtattaagagcgccggggtaaagaacccgctgctccttctggatgagattgataaagtcagcacagactataagggagatactttttctgcgcttctggaggtgttggacagtgaacagaacaatcgtttccgtgatcattatctggaagtcccggtcgatctgtctgaggtgacatttgtaacgacggctaactcgctgcagacaatcccccggccacttcttgaccgtatggaagtaattgaggtcagcagttatacggagaatgaaaagctgcatattgcgacagaacatctgattccaaagcagttggaaagacatggactaacaaaagaacagcttacgatcagcaagggcgtgatctggaaaattgcgcagaactacaccaaggaagccggtgtgcgtcagatggagcgtgaaatcggtaatatctgcaggaaggctgccagagagatctatgaacatgataaaaagagagttcaggtaacagagcggaatattgaaaagtatcttggaaaagaaaagtacacctatcagatggcaaatgccgaggatgaggtgggaatcgtccgtggtctggcatggaccagtgtaggaggagataccctgcagattgaagtgaatgtaatgccaggaaagggtgagatcattctgacgggacagcttggcaatgtgatgaaagaatctgcgcaggcaggaatcagttatatccggtcaatcagcagtaaatataaggttgctgaagatttctttgaaaaacatgatatccatatccatattccggaaggggcagttccgaaagatggaccttcagccggtattacgatggcgactgcgatgctctctgcaattacagacaagaaagtgcgtgccgatcttgccatgacgggtgagattacgctgcggggaagagtacttccgatcggaggactgaaagagaagctcctggcggcaaagaatgccggaatcaggacggtacttgtaccgagggagaacaaaaaagatgtggatgaactttcttctgagatcacaaagggactggagattattccggtatcgcagatggaagaggttctgaaaatcgcacttatgcgcacacggaggaaaaaagatggtaattaagaatgtaaatctggaaacagtctgtggaattacaagtaaattgccggatcacaccttgccagagatcgcatttgccggaaaatccaatgtcggtaaatcctctctgatcaatgcactgatgaaccggaaggcgcttgccagaacttcggcaaaacctggaaaaacacagaccatcaacttttacaatatcaacgaagaaatgtatctggtggaccttccgggatacggttatgcaaaggtttccgagcaggagaaggcacagtggggaaagctgatcgagcgttatcttcatggctctaaacagctgcgagctgtcttccttctgatcgatatccgtcatgatccatctgcgaatgataagatgatgtatgactggatcgtggatcagggattcaatccgatcattatcgcgacaaagcttgataagctgaagagaagtcaggtacagaagcaggtaaaggcaattaagaccggactgaagctgcttccgggaactgttgtgattcctttctcagcagagacaaagcagggacgggatgagatctggaatcttgtagacacagaatttctgggaaaaggaacagaggaataaccttgaaaaatccactgcattatcagtttccggattatgattgtggaccgacgttcatgcagaatgcgatcagctttctcaatgcatccaaacaagatgtatggcgattcgggcgctgatacctcaagtgggttgcatcaactaagatacggggagaaaagttcacccccgcaaattccgctttgggcgggatttgtgggggtcgctttttctagttggttggcaagaaaagcaagtgggataccaatttttagaatgtggatatcattttagatttcttgccagattatataaatttttgattacatcagttttctaaacagatctttcagatcttctacggatgcgtcttttggatttccaggtgcgcaggcatcggcgtgggcagattctgcgaggaactggagatcttcttctttgagggcttcgagtttggatgggattcctacgtcttcagagagtttgcggactgcatctacagctgcttttctgtattcttcctgagacatattatctacgccttcaactcccattgcgcgggcgatttcacggtatttttctcctgtgcagtttgcattgtattccattacgatcggaagcatcattgcgcatgcaacaccgtgtggtgtgtcatagactgctccaagggtatgagccattgagtgagcgattccaagacctacgtttgagaagcccattccggcgatgtactgtccaagagccattccttctcttccttctttggtgttttcaacagcaccgcggagagatttggagataatctcgattgcttttaagtggaacatatctgtcatttcccatgcggcttttgtggtgtagccttcgatcgcatgagttaatgcatccataccggttgaagcggtcagtccttttggcatagaggacatcatttccgggtctacaacagcgatgatcggcatatcatgtgggtctacacagacgaatttacgtttcttttctacatctgttactacatagttgatcgtaacttctgcagcagtaccggctgttgtcggaacggcaatgatcggaacgcaaggtttctttgtcggagctacaccttccaggcttcttacatcttcaaattccgggtttgcgatgatgataccgattgctttggaagtatccatagaagatccgccgccgattgcgatgatgtaatcagcacctgaatttttgaaagcctgtacaccgtgctgtacgttctcgatagtcggatttgctttgatatcagagtagatttcgtaagaaagtccttctttgtctaagatatctgttactttggaagtaacattgaatttgatcagatccgggtcagaacatacaagagcttttttgaaaccatgagcttttgcttctgttgcaatctctgcgattgcacctgctccgtgataagatgtctgatttaacataattctgtttgccatgatacatatctccttttcgtttatggtaaaatcacttgtttctgatactattttaactataagaaggcggtaaaaaaagttacagaatatgaaaagtgtaacatttatacaaaagcttaagacaaaatatgcaaatcagtgaagagttgcacaagtttttccggcatgccaagtaccagttgttttgcaagctgcgcaggcggaaattgcattccgccaagcagccatttgacagtcatgtaaatcgagccacggcagtacatctctaaaagaaatgaagtttctgcatccgggcgtcttccggttttctggaaaataaggtttgaatagaattccagaatcagttcaaaatcatgttcttttaaagagttctgatcgtcagagcggaatgctgcagcgaaaaacaggtgctcttcctttaaatattcaaattttttgaccagtccgtcataaacagtggtaccttctcccatatgttcaaatgattttagaagaagtttgtcaaaataccagttgatcagatcgtatttatcaagaaaattgcggtaaaaggtctggcgtgtgacgccgcagacttccacaatctggcggatggtgatatcatcgacagaagtggtcttcatgcaggttttcattgcttcggcgagccggtatttggtagattcggatttggccatgttcaattctccttaatcgtaggcatgttttttctatataagtagtacggtatgatcaaagctgtggtagtgatccaggaaatcggataactaagcattacacaggttgtggtatggtgtgccggtaagacaaacataatccacggaatacggatcagacatacgccgccaagtgtgatcagtgtcggcagcaggacatcgccggttccgcgaagtgcaccggagagaacttcaataaatacataaatagtgtagcacggtgccataaaacgcagcatatcaataccgatattgatcacattttgatctgtcgtaaaaattgagaacagtgggcggcagaagatggctaaaaacagcacgatccctccgcacacagccacagccattgcaaggcagatacggacacttttgaaaatacgttcttttttacctgctccataattttgtccggcaaaggttgtgatcgcaattccgaatgctccgttgactgtccagaaaagcgcatccagtttaccaaaagaagcccatgcagcggcagtatcggttccgaaaccattgattgctgcctgaataatgatattggtaatactgtacataaatgcctgcagtgcacttggaataccgatgcggaattccatacgcagcttcaaaaggtctatgtgtagtttgctcagataaagcttgcagtcatcatattttttcatcagtgcattggtgacaaggattgcacttactgcctgtgaaataatggttgcgatagcggctccgacaattcccatatcaaatacgattaccagtaccagatcgaggatgatgtttagaaaacaacagacgatcaggtaatatagtggtctgcgggaatcaccgatggagcgcatgatggctgagcctatattaaagatcaaggtaccgaaaatacctaaaaagtaaatccgcagataaagaatagaatccgcaagtgtatctgcaggtgtatcgatgagcttcaaaagaaatggtgttaaggcccatccgagtattgtaaatacaatactgagaatagcggaaaaagcataggcggtatgcagactcttttgcagattccgctcatcctttgcaccataaaactgggaaacaattacagatgcaccgcttgcaagtcccgtaaaacatccgatgatcagattggaaagaacggcagaagatcccccgactgcggcaagtgcgccctttccgacaaaacgaccgacgatgacagcatctacggtgttataaagctgttgaaacaaagttccaactacaataggaaagaaaaaaatcaataattgcttccagataactccttcggtaatctgattggtttttgtactttcgtttgacatgttaataacctccaatgaaaaaactaaaaaaacatacctaaacgaagtataacatgaagtcggaagaaaagatatcagatgaagagaagtttcatagaaataaaaccaactttgactaacaccgtatgaaatggtacaattgaaacactacgagaaaaaaggagtacaaagaaattatggaaaaaacagttgaagcagtaatctgcggacatgaaattacatcagcagaggtagatgcatttatcgcaagccttccgagagaacagcaggtatacgcatcccatccggatttccgcaaacagtgtgttgatcagctgatcgcagtttatgcacttgcaaaatatggtgaagaagaaaagttagacgagacagaaaagtttaaagcaattctggaaaatgcaagaaaagatatccttgcacagatggcgatcggcaagatttttgagggaatcacaatttcagatgaagagatcagagaatattttgaagcaaacaaagcaagatttgcaaaaggagcatctgttcatgcaaaacatattctggttgattccgaagacaaatgtaacaaactacttgaatccatcgtaagtggtgggaaagcatttgaggatgttgcaaaagaatcttctacctgcccgtcaggagcaaacggtggagaccttggcgaattcggaaaaggacagatggtcaaagaattcgaagatgccgcatttgcagcagaaatcggacatgtggttggaccggtcaagacacagtttggataccatctgatcaaagtggaagataagaaagaagccgaagatgcgaagcttgatgatgtaaaagagcagattaagagtgagatcatgcagaaaaagcagcaggaggcttataccgcgaaggtggaagcactgaagaagaaatatatggcatagtatttgccaggatttcattcgattgataaaaaacagcaggacagattaatttttatcggatctgcacccattgcgcaggcaatccttctatctggaatcacttgtgctgccaactctcatttatgaaatatttgtgaaaactcccccgcagatttgacgaaacacgaaaaaagttgtagtatatatgacggaattgttacagaagtgttaagaaacggaggtacggatgcagattcgcagtgcagcaaaatggatcgcagcggcagcagggatactggttggcgccgttatcgtaggatttacattaaaagatactacatatatagaagcaaaattagaacagatcaaaggagcaagacagtctgttacagcagtggagaaaacgacagcaaagacgcagaagataaaaaatgcggaaatagtgaaagagacaccccttccggagagtagctgtatttctgattttgcatttacaggacagatgccggagcttcctactggatgtgagatcacatctcttacaatggctttgaattattatggatattctgcagataagatggcaatggcactcgaatatttaccgacagttggatggaccaacacttattacggagacaatgaaactttatatggaaatgatatttacaattattttataggaaatccacagtcagagacggatggattaagctgcggagcgggagcaatcgtgacggcagcagatggctatcttgcagataatggaaatgcaatgaaagcagaggacgagacaggatcagagccggaacagctgtatcgttttgtaagtgaaggaacccccgtggttgtatggggaacaattggtatggaagaacgtcagataatggaaagctggaatacggaagatggaagagaagccagctgggcgatgaacgatcattgtgttgtactgatcggatacagtgtagacagtgtgactgttgcagacccgatcgaagggattgtgagctatgacagagcacagtttgaatcggcttttcgttccagaggtaatcagtgtgtgattttgaagaatgtacaatagagaagtgggaggtactttgcagataaagacagtctgtgaagtatctcttctttatatatgtgatgagctgagtgcagagtttcgtctgcttaaggaaagaagatcaggattgtaaaaatatttgagaagaagtttgccaaaggattgacaattatttgtttttttggtatctttagactatggtacaaacgttagtctaaaaaagcgaaatgacaagaaggagagctaccatgaatttagtaacgaatattcagaagtattcgatccatgacggagatggaatccgtactactgtattttttaaaggatgtccattaaagtgcgagtggtgtcacaaccctgagacacagcgttttgagagagaacttcagtgtgataaagaaaagtgcgtcggatgtggaacctgtgcgaaggtctgtccgaacgatgccatcacgatggtagatggaaagccggagcttgacaaagagaaatgtcagctttgcggaaaatgcgataatttctgcccacagggcattcgggagattgtcgggcaggagtatcctgtaaaggaactggtaaaagaactgatgaaagaccggatgttttatgaacagtccggcggtggagtcacactttccggcggggaagtgatggcgatgtcaacggattatattttacagatcgcgaaagcacttaaaaaagaagaaatttcgcttaccattgacacctgcggatatgtttcgtatgataaatttgaagcaattttaccgtatgtagatacgtttttatatgacgtaaaagtgatggatccggaattacataaaaagtatatcggagttgacaataagctgatcctggataacctggtgaagctttcagatgcaggggcaaggatttacatccgaatcccgacgatcaaagaagtgaacggcaatgtgcagaacatggaagataccattcattttctgaagaaacacggcattcacccggcacaggttaatctgctgccttaccataatacaggaagcagtaaatatccgaagctgggtatggaatacaagggaactgatttacatgcaccggaaaaagaagagatggaaagttttgtaaagctttttcaggatgcaggatataccaacacaaaaataggaggataagaaaatggcaagaggcatgaatgaaagaattcagaagctgagagaactgagtgttacaacaccggttcacattgatctcgaaagagcaagaatcgagacagatttttacagaaaaaatgatggaaaatattcgattccggttatgagagccatggtattaaaagaatatttttcaaagaagacactttatctgggagacggtgagctgatcgttggtgaaaaaggaaaagatccacaggcttctcctacattcccggaactttgctgccacagcaaagaagatatggtagttatgagtgaacgtgacctcgtatctttccatacaacagaagaagatcgtgagatccaggagaaggaaatcattccttactggtcaggacgaagcatgagagagaagatccttgcagctatgactccggaatggaatgactgctattcagcaggtatgttcacagagtttatggagcagagaggacctggacatacatgcggtggtgaacagaactttaaagttggatatctggaatacaaagaaaagatcaaaaagactatggatgcgctggatttcatgaatgatccggaagctaccgataaaatggaagaactcaaagcgatggatattgcatgtgatgcagtaatcatccttggtgagagatatcacaaactggctcttgaaatggcagaaaaagaagcagatcctactcgtaagaaagaattagagcagatcgcagccaacctggaagttgtaccggctcacaaaccgcagaccttctggcaggcaatccagttatactggtttacacatcttgcggttacaacagaactgaacccatgggatgcattcagtccgggacgtctggatcagcatctgatttcttattatgaagcagatacagaagcaggaatccttgatgacgagaaagcaaaagaactgcttgaatgcttatggatcaaattctacaaccagccggcaccggttaaggttggtattaccttaaaagaaagtgctacttatgtagactttgcgaatatcaatacaggtggagttacaccagatggtaaagacggtgtaaacgcagtcagctacctgatccttgactgtatggatgagatgaagcttgtacagccgaactctaatgtaaccatcagcaagaaaacaccggcacgtttccttaagagagcatgcgagatctcaagaaaaggatggggacagccagcattttataatacagaagcccagatcatggaacttgtcaatgcaggtaaatctctggaagatgcccgtcgtggtggatcttcaggttgtgtagagacaggagcatggggaagtgaagcatatatcctgaccggttatatgaatattccgaagattttccagctgactctttacaacggttatgatgcaatgtcaggcaaacagctcggactgaagcttggttatgcaaaagactttaagacatttgatgaactgtgggatgcattcaagaaacagatgaagcatttcatcgatatcaagatccgtggaaacaacgtaatcgagagattatatgcagaaaatatgccggcaccgtgtctttccgttgtaacaaacgactgcatcagtaatgcaaaagactacaatgcaggtggagcaagatacaacaccaactacattcagggtgttggtatcggaactgttacagactgtatcgcagctgttaaatacaatgtatatgataagaagaacttcacaatggaagaactggtcgaagcaatggatcataactttgaaggatacgatgcaatctatcgtatggtacacgataagacaccaaaatatggtaatgatgatgactacgcagatgatctgatgcaggatgtattctatctgtatcatgacctgatcacaggacgtccgactatgagaggtggaaagtacggagttgatatgcttcctacaacctgccatgtttacttcggagatgtgatcggagcaacagctaacggacgtaaagcacacatcccggtttcagaaggtatttcaccggagaaatccgcagatgtgaacggaccgacagcagttatcaaatcctgcgctaagatggatcatcttgctacagcaggaacacttctgaatcagaagttcacaccggacgttgtagcaggagagaaaggtcttgacaatatggcaagtctgatccgcagctactttgcaatggatggacatcatgtacagttcaacgttatcgacagaaagactctgcaggaagcgcagaagcatccagaagattacagagatctgatcgtgcgtgttgcaggatacagtgatttcttccgtaacttaagcaaaccgcttcaggatgagatcatcaaccgtacagagcagtcattcgaatagaaaataaccagagaaattgaaaaaggttaaataaaggaagaggcaggagcaccgcaatgcagagagtaatctgtgtgtggtgcttctgttttttttgaacaatgaaaaacattttcaaatttcattgacatataaaaataatgtgataaaatgaaaacgatttccaaattgaagggaggaggtcagtatggcaaaagcaccatataaaacaaaacaaatgaccgaaatacttaccttcctgaaatcggtacagggaagacatgttaccgtgaatgaaatctgcgattttttcagggaaaaagggatttccgtcggaaccacgaccatttaccgtcatctggagaagatggtgaaagaaggtctggccgcgaagtatgtaatagacggttcgagcagtgcctgttttgaatatatcggagatcatggggaagaatatgaaaactgctatcattgtaaatgtgagaaatgtggaaagctgatccatttacagtgcaatgagatagaaagcttaaaacagcatatgcagcagcatcatgattttcagatggattcgcatcgtactgtgttttacggaatctgcggtgaatgcagtaagaaagaataaataaaatttattaacagatgaaatctgggaaaggagaaggagatggatacaggaaagaaaaaaagtatggcagcggttatatgtatttttcttatatttgtaacctttgcttctcttttttatgttgccagagaggaagatcataactgtacgggaaaggactgcccgatctgtgcctgcgttcatcaggcaaagcaggtccttcggaatctgggaacaacacctgcagtaggattttttgtcagtccggtgatctttatcgcagaaactgttattttgccggggttctggatcattttgtcgatttcgttagttcatcaaaaggtaagattaaatgattgaataaaactttttataaagcagaaagggtatgaaaagtcatacctttcctttggatatgatgagcatgtatggctgtctgtaaaaaatgcagaagtgctgagtaaggaaattgcagacgcgctggaaaaagcagacccggatcataaggatatttatcaggagaatgcatctgcatacagtgaaaagctgaaagacctggatgctaagtatcaggaagttgttgatggcgcgtcacagaaaacactgctgtttggtgatcgttttccattccgttatctggtagatgattatggattaagctattatgctgcatttgtcggatgaagattatctggaacaggaaacagaaattatcgttcagggaacgttcgagacatataaagaaccaaatgatgagactttgtattgcaggatcacagatgcggatatgcagataaaaaaataagaagagaaaagatggatcatgaaggaatacgggaaaaagattagcagatatttgatgaaaaacaaaaaaggaagattttattgtgtggcaggtgtgttgtatctgctggcaattctgtttgtcatgaatgatgcctggctgtatcagacaccgatcgtgaaagtgacaaaagtggtgacaattgtagaagggaaaagcaaaagtacacgtggaacagaagaaacgaaatataagcagagtctttatggcaaaatcataaacggagaagacaaaggaaaagaagtccgtattgccaatgaatacacaacaacagaaatggctgaccaaaaataccataaaggtgaccgggtgttttataagggatcatcgatcattggagtaaagcgggatacgatgctggttgttatgcttggcttccttgcacttctgctccttgggattgccggacggcagggcggtttgacgatcataacagcaatgatgaatatcctgatttttgtgatcggtttctggacggcggatgacacatcggaaattctaagtgtatgtagcagactgattcttttttttgcagtggtaacgcttgttggattaaatggaatccacaggaaaacttttgccgcactattgacaacactatgtgtcctgcttatgatcatggggatatttgatcttgttatgcagcatatggaagaactggattattcgacgatggaatatctgggcagtattgataatccggatgaaattttccatgcagagattctgttgtcaggactcggtgccatcatggatgtggcggttgccatatcggtggctttaagcgagattgttgagcagaaaccggaagtaaaatttgtggaacttttccgttcgggcagagagatcggatatgacattatgggaacaatgatcaatgtgctgttgtttgtgtttggctgcggtctgattcctacatgtttgatccggatgaacaatgaggtgcgttttgttaccattgtaaaattgcatattccatgtgaattatgccgtttctttgtagaaagtatcggaattgtactggcgatcccagtgtctattttcataacagcagttatgatgaaactatctgtgaaaaagagggaaaaaagatgttgatcatattgggactgattctaatgatagtaatagtgcttgttggaggggacagaggcgccatgtctctgatcgctctggcgggaaatattttgtgcctgagtcttgcaatctggctttatgccgtcggagcacccgtgtttctggttactgccggtgcaggaattttaatttcctgtatcactttgttttatcaaaatgggacgaatattaaaacctggagtgcatttcttgcggttgcaattacaatgtgtgtgttatttgcatttatttatctggtcgtatggaaaagtggggcgggaggcttgaatgagatccaggcagccggagaagatgttttctattataatatgaacctggatatcagtatgcccaaggttgcaacagccgtaattgtactcagcacgttaggagctgtgatcgatatggcgctgacagtaacaacttccgtatatgaggtgaaatgtcataagccggatatcaaaatgaacaaactggttcaaagtggaatgaagattggaaaagatgtgatcggaacaacagttaatacgttattgtttgcatatctgggagaatcgctgttgctattcgcgtatttgagaatgcagaattactccattgagctgttgctcaactccaaaattctttttcagaactgtatttccatgatttttggagcaatttcctgcacaatgataatgccggtttcagcggttttgatcgcaaaaaactgtgagctttttgattggatggaaaatagtaaatagcaggttgacagcagggaaatatctgtgataaacttgtttaggattaaactgtttacgaatgaacaatttattcgtgaacagttttctttttttgaagaagcaaaaagtggaaggaggaaagtcatttgtgtgaaggatgtgaagagcgaatccacgtaggacatcaggtgcaccggatagaccgttcgatttcaaaactgctggaaatgcgtgtaaaagaagaaggactggatgagattgccctgatgcatggctggatcttacgttatctatatgaacatcaggataaggaaatttatcagaaagatatagaaaagtattttggtatctgccgttcagcggtaacaaatattatccagactctggagaaaaaagggtacatctgccgtgcatcggttgcaaatgatgcgcgtctgaaaaaagtaatgctgacagaaaaaggacgggaaaaccatgaaaaactgggagaaatttttcagaaaatggatgcacagttggaagaaggcattacagaagaagaattacatgcatttatgcatgtgatcgataaagtttattacaatatggaaaaaatgaaaggagagaatttatgattcggactttattaaaagaagtaaaagaatataaagcggcatcgatcgcaacaccgttttttatgattctggaagtattgtttgagacattgattccatttctgatggcatctattatcgataagggtgtcaataccggagatattcaccatatttacaaagttggtggaattatgatcgtggctgcattttgtggcctgcttgccggaatggcaggaggacgatacggagcaaaggcttcgactgggtttgcgaagaatttgagaaataagatgttcgatcagatccagacctattcgtttgcaaatattgatcatttcagtacagcaggtctggttacacgtctgacaacagatgtgaccaatgtgcagaatgcgtaccagatgatgctgcgtatgatgatgagagcaccggcaagtatgatctgtgcaatggtgatggcatttatgatcaatgccggactggcaagtatttaccttgtggcagttgtgatcctgggagtgatcctcttctttatcattcgtcatgcaacggcttatttccagcaggcatttccaaaatatgatgctttaaatgcatccgttcaggaaaatgtatctgcgatccgtgtagtaaaagcatatgtaagagaagaacaggaaacaagtaaatttcagtatgcaagtaagaatatttacgatatttttgtaagagcagagaaaaatgttatatggaactcaccgatcatgatgttcactgtttatacctgcatcatcctgatcagctggtttggtgcaaagatgatcgtagtgaaatcgttgacaacaggagagttgatgagtcttcttgcatactgtatgaacattctgatgagtctgatgatgctgtctatggtatttgtcatgatttccatgagtatagcaagtatgcggcgtatagcagaagtactggatgaaaccagcgatatccataatccggaacatccgctttatgaagtggcagatggaagtatttcatttaagaatgtagattttgcttacaaaaaagacagtgcagagaaagtcctgaagaatatcaatctggacatccattccggtgagacgattggcatcattggaggaaccggaagtgcgaagacgagtctggtgaatctgatcagtcgtctttatgacgtgacaggcggagaaatcctggttggcggaaagaatgtcaaggattatgatctggaagtactgagaaaccaggtatctgttgtattgcagaaaaatgtactgtttaccggaagtattctggataatctgcgctggggaaacaaagaggcgaccgacgaagaatgtatggaagcatgtcggcttgcatgtgcagatgaattcattgagcgtttcccggataaatataatacccacattgagcagggaggaaacaacgtatccggtggtcagaagcagagactgtgtattgcaagagcactgcttaagaaaccgaagatcctgatcctggatgatagtaccagtgcggtagatactgctacagatgcgaagatccgccgtgcattccgtgaagaaatcccggatacaacaaagctgatcattgcacagcgtgtatccagtgtgcaggatgcagaccgtatcatcgttatggatgaagggcaggttcatggatttggtacacacgaagaattgctgaagaccgatgaaatttaccgcgaagtatacgaatcgcagactcagggcggaggagattttgatgaaaacggaggtgaagcataatgccaagaccgatgggaagaccacagaataaagtgaaatatccggggaaacttttgatgcgtctgataaactacattttccgtgattataaagttcattgtattgcagtatttatccttatatttgtaggagttatcgcaaatgtgcagggaacgatgtttacaagagatctgatcgacaaatatattacaccgttcctgctgtctgacggtacaccgaacttttcaccgcttgcacatgcaattgaaagggttgcggtattttacggaatcggaatcgttgcgacttacgcatataaccgtatcatgatcaatgtgacacagggaatgatgatgaatatgcgtaatgagctgtttgaacatatggaaaagctgccgatcaaatattttgatacccatgcacatggtgatatcatgtcaatttacacgaacgatatcgataccctgcggcagatggtcagccagagtattccgcagatcatcaacagcggatttacgatcatcagtgtatttgtcagtatgttgatcttaaatattccacttacggttgtgacgatgatcatggttgcaattatgatatttggtaccaagaaagccgccggacagagcggaaaatatttcctggaacagcagaaaaatcttggaaaagtcaatggttatattgaagaaatgatgaatggacagaaggttgtcaaggtcttctgccatgaggaagaaagtaaggcagaatttaaagagctgaatgaggcactttttgtaagcgcagaccgtgcgaatacctatgcaaactacctcggacctttgaatgcgcagatcggaaatatcagttatgtagtctgtgcgattgtcggaggtgcccttgcgctgaatggtgtgggaggatttacactgggtgcactggcaagctttctgacattcaataaaagctttagtatgccgatcaaccaggtcagccagcagatgaatgctattgtaatggcacttgcaggagcagagcgtatctttacccttctggatgagaaagtggaagtagatgacgggtatgtgactctggtcaatgtgaaaaaagaaaatggaaaacttatagaatgtaaggaacatacccgatgctgggcatggaagcatacacatcaggcagatggttcggtagattatattgagcttaagggaaatgtagtatttgatggtgtggatttcgggtacaataatgataagatcgtgcttcatgatgtgaaattgtatgcagagccaggacagaaaattgcctttgtaggttcgacaggagcaggaaaaacaaccattacaaatctgattaaccggttttatgatattcaggatggaaaaatccgctacgatggaattaatataaacaagattcggaaagcggatctgcgacgttcccttggaattgtactgcaggatacacatctgttcacaggaacggtaaaagacaatatccgttttggaaaactggatgcaacagatgaagaaatctttgcagcagcagaattggcaaatgcagatggatttatccgcagacttccggaaggatatgatacggtcatcaccggggatggggcaaacttaagccagggacagagacagcttcttgcaattgccagagcagcagttgcagatccgccggtactgatcctggatgaggctacaagctctattgatacgcgtactgaacgtattattcaggaaagcatggacagactgatgcatggacgtactacgtttgtgatcgcacaccgtctgtctacggttcggaattccgactgtatcatggtcctggaacagggacgcattatcgaaagaggtacccatgaccaactgatttcagaaaagggaaaatattatcagttgtacaccgggaatgcaattgctgaataagattcaaaagacaggatgttactgttcacagtacctgtgaccagcaacgcatctcgccattttaaatcgcctttggcgatgggcgagatgccgttcaagataaaacgtgcatcctccgtgccaatcagcgtagtgattgacacgggagtgaacagtaacaacaggattcaacaaaatttacataaattaaaaaatactatcaatttttttgtgcatacgctatacttgtatatatagcactgcaagtccttccgagcagagaagtaaaatagcagttctataaaaatgtcatgatagggtaggtttgggaatgaaaaaacaaatcaattgcaaagaagttgtatgggaactatttacacttaccgctgcagtggcaattatcgctgcagcggtttatttctttctggtgccgagccatgcatcggtcagcagtatttccggtcttggaattattcttacgaattttatacctttaccgctttcagtgatcacgatggtcctgaatgttgttcttttgatcatcggattcataacatgtggacgggaatttggtacgaaaaccgtgtataccagtatcttactgccggtatttatcggtatttttgaacggattttcccgaatatcggttccctgacaaaaacccaggaactggatgtcctctgttatgttctggtagtcagtgtaggactcagtattctctttaatatgaatgcttcttccggcggacttgatattgtggctaagatcatgaataaatatctgcacatcgaattggggaaagccatgtctttagccggtatgtgtgtggcgctttcggcagcacttgtatatgataagaagacggtggttttaagcgttcttggtacttattttaatgggatggtggtagaccattttatcttcgggcagaatctgaaacgaagagtgtgtattattacaaagtatgaagaagaacttcggaattttattctgcatgagcttcatagtggagcgaccatttatgatgccatcggagcgtacaatttagataaaagacacgagatcattacgatcgtagataaaaatgagtatcagaaactcatgaattacatcaataatcttgatccgaaggctttcatcacagtgtacacggtggcagacatgagataccagcagaaggttttggaaaatgaagaaagaagttagtgatctactccatcaggtttgcaaaataataaatgtacaatattctgttataataatgtacaaagaaaggaggagttacaatgccaataataaaaccaattacagatttaagaaatacaaatgaaatatctgaaatatgtcacaaacaacagcaaccagtatttattacaaaaaatggttatggagatttagtagttatgagtatggaaacttatgaagaattactcagcacaaatcagattgataaggcaatttttgaagcagaacgggaagtcgcagaaggtgcagaattattagatgcacgtgaggcattgagagaactcaggaggaaacatttgggataaatataccgtaaaaatgtttccacaggcatatagagatattgataagatatacgagcaggcacttcttgttagtaattatgctgataatgcaattgcactggcagaaaaacttgaaaaagcaattttaagtttggaagaacagccatatcgaggggcagaaagaaaatatggaaaaagtgagttttagaatcaagaaatctcactgaaatataaagggtactaaaaaacgtcacaatttgtggcgtttttttagtgcaggaaaaaggagaccaagagtgtcagaaatcagattttcatcaaaggaaagaagctgatatcttatttgaaaaaagaaaagaaccatttaatatttatgaatattgcaaaaagtagtaattttttctgttaaaaaagtcctgagggataattttatataaacggatattattctaataagcgcaacggatgatccccataccacaaacggtatgattgtagaacaaatttaacatggtctctgatagcatagaaattatgcatatcacagttatagagcataccattagtcaaatctattgtatttacaagaatatggacgtgaagatgactgttattttcatgaatcgaaaagataacctggtattgagcattacaaaattcaaacggaaaaagtagcaattcctccggaactgtgatatactgtgatcgtttggaagattagtggactgaaatgtaagatccccagagcatgaagtataaagagggcagaaacggcaatgtcattaagttaaggaaaaataattagattcttatattagaaataatataggagtctttttattttgtaaaaatagttgacaaacaagatagaatgtgcggccgctttcgctaccgatatatattaaggttgcgaaagcggcccttgtaattaaggaatatcttgattgcaaggaggatacattatgagtcactatattgaaaaggttacggtttcactagaaaatctaatttcagaattggcaagaaatccatctttgttcttgaaaaatccagatactgatttttcaagaaaccgcaaaattaattttaagacatgtgttggcattaccatgaattccggcggttgcacgctgaataaagaactcttggattttttcgattttgatgtgaatgctcctactgtttcagcgtatacacagcagcgggctaaaattctaccagaagcatttgaatacttatttcatgcgtttacagaagaaaatgctcaaacaaaaaacttatatgagggatatcaacttttggcttgcgatggcagcaatctaactattgcaccgaatctaaacgacccggaaactctttggaaatcaaatcaacttggtgcaaccggtaatcacttacatctaaatgccctgtatgatgttttaaacagaacttatattgatgcattggttcaaactgcctctacgtatcaagaacacagagcatgcattcaaatgatagaaagggtgacattggacaaagttatattaattgctgatagaggatatgaaaactataacattatgtctcacgcaatagaaaaaggctggaaatttttgattagaataaaagatgttcacagcaatggcattgcatcaggcttagaacttccacaaacggcagtttttgatatggatatcaatctgattctgacacgaaatcaaactaagtcaaagaaacaagcaggatataaattcatgccaacagtacaaacctttgattatcttccaataggaagcaaagaggattatcctatctcctttagaattgcaaggtttaaaatagcagatgattcctatgaaacggtaattacaaacttggaccgtttttgcttttcggcagaaaaacttaaggaattatatcacttaagatggggcatagaaacatcatttcgtgaattgaaatatgctatagggctaactagttttcatgccaaaaaagtggattacataaagcaagaaatatttgcaagattgaccttatataattactgcgaattaattacaacatatgtagttgaacacacagaaaatataagtaagaaaaatcaggtgaactttactattgccatttacatttgcagagaatatctgcgacgcaaacggaaacttcgtccacctgatgtggttaaactgatagaaaaacatatattaccaataagacctgggcgtcgagaccctcggaaagtcaaacatcaggcgtcagtaagttttctatacagggtagcataaccattcatcattatataggattatagacagatgtacaatccatctgtctgtttgccgtgcaaaaaaacagataacaaaatgaaaaaagcaaaatacaagtgagattttacctacttgcattctgctttttttaatttttaaattaacttaatgacattggcagaaacggggctcgcagatatatggcagaagagctgtatgtcgagaacaccgggtatccgtatctgacttcatgttctggggattttttatattctgtacgcggattttccgaatgtatgcaaaagaaaaacaataaaaaggataggagaggaaaagatgtttgaattatttgaaaatctgaccaattggctctggggactgccgctgctgatcacgattctcgctacaggcgtatatctgacagtacgttccggtttcttccagttccgccattttggttacattgtgaaaaacatgttcagtaaagaacgccgtcaggaaggcggagacgacggaaagagcctgacaccgttccaggctatttctattgcgatcggcggtactgttggagtatccaacatgtccggtgttgcaacagccattgcaacaggaggacctggtgcattattctggctctggatcgcggcgcttcttgctatggccatcaagatggcagaggtaacacttgctgtgtactacagagaaaaacagccaaacggtgagtaccagggaggcccgacctactacatgcagaagggtcttggcggagagaaaaagcttcccttctggaaactttttgcagtactgttcggcggctgtatttttatgacatggttcatcaccttacagaattatacagtatcagaggctgtcggaagtaccttccacctgccgtacatcgtgccgtcacttctgtatgtggcagcgatctacctgatcatcattggcggtgtaaagaaagtcggtgtgatctcttcctatatgacaccgatcatgtgcatgctttacattgtaggatctcttgcaatactggtagtgaattttgacaagctgccggaaacctttggactgatcttcaagggtgcatttacaacacaggcagcagtcggcggatttatgggagccggtgttgcaacagctatgcgtcttggatttgcccgttctgtatacagcaacgaggcaggctggggaacctcacctatgatccatgcttccgcaaaaacagaccatcctgtaaaacagggactgatgggagcatttgaggtatttgcagacaccatcgtagtctgctccatgacaggtcttgttgttattaccacaggctactggaattcaggacttcagggatcagagctgacactgacagcatttgagtccggaatgggctctgttgcgagagcactgatcgcgatcagtattttccttttcggactgacaacatcaaccggatggttcacctattacagcgtgatcctgaagcactggctgaaaaacaatcagaaggttctgaagatcgcagagaaggtttttatccttggaacgccattatggggtcttctggtcacagtgcttactctttacggaaacggaacaccggcacagctgtgggtaattgcagactttacaaccgtattccctacatttgtaaatgttgccacattatttatcttaagtggtaccttctttaaactgctgaaggattataaggcgcgttacatgggaatcggaaaagtagacaaggatatggcacttttctacgaggataaaaaagaaaaagaggaaaaataaacagtggatacgatttttttaacggatgtataagaacactggataacagtgaaaaagtggcagaggctgtgggaatcgaaaatggccggatcgtttttgtgggaactgataaagaagcggaagctttttccagcaaaaaacggattgaccttaagggaaggctgatgctgcccggttttgtggatacacatatgcatatgttgcattatgcatttgtggaaagatctgtgaaactgtttgactgcacaagtgttgaggaaatgcttgctgcagcaaaaaaaagactggaggagagtaaaggtcagaagctgacctggctctactgcagaggctggaatgaggagcattttgataagccgcgctatccgcataaggatgagctggatgcactctcaacggaaatccccatcattatggtgcgtgtctgcgggcatgtggctgtgtgcaacagctgtggtctggagcttctgaaaaaaatcccggagtttccggagattgagaaggaggttgatctggataccggacttctgaaggagaatgcagtacagttttattcttccgtattggaagcaccatcccaggaagaagtggaaggctacatcagatacagtgcgaagaagctgaatgaatgtggatttacaggtgtacagtccgatgatcttgcctcccttccgggaaaaaactggcgtcggatcatggcctcctacaaggcactggatgccagaggagagctgagtatccgccattatgagcagtgcctttttgagcgggcggaggatgcgaaggcttttatcgaggaaggatatcgtaccgggcagaggggagatcactttactgttggaccgatgaagctgatccaggatggttcccttggtgcaagaacagcggccatgaatgagccttacgaggattcgccggaaaataccgggatcatcacattcagtcaggatgagcttgacgatctgtttgctttttttgaccggcatcagatgcaggcggcggtacactgtataggcgatcgtgccatggatatggtcattgaggcagctgcgaaatctccttaccggaaggataacaaaaagggcagacatggtatcgtgcattgccagatcaccaatccgcgtattttgcaggggatgaaagaccaggatctgctggcatatatccagccggtatttatcgatctggatatgaacacagtggaacctgccatcggcgcacaacgtatggataaggtgtatgcatggaagagtatgctggatatgggaatccatacgtccggcggctcggatgctcctgtggtaagctttgatgcaatggagaatatttattttgcagttacccgaaaaaatatcagcggtcagccacaggaaggctggatcccatccgaaaaaatatccgtagacgaagcggtgaagctttttacaaaaaacgcagcttacgcttcctatacagaagacgagaacggaaccatcgaagtgggaaaaaatgcggacttcgtagttctcgagaagaatatctatgagatcgacccggatgagatcaaggccacgaaagtggatatgacagttcttggcggtgagatcgtttatgagagagaagtagaagaatagcggcagtataaaaagaaaaaagtgagaggcagagtctgagtggagcaggctctgctttttttgatttcagtaaaaatatagaacaagatgtataccataacggtgaacaaaattcgtcgaagaaagcagtaacattgttacatggaaaatattgattgagaaacgagggtaaactggttataataaaatcaaaaaatttatagtattatcagcagaaaatgaggtgatgatgtatgccaaagattatgcaggatttaattaaacagtatgtggaagcggtcaagaagatttatggttcccatgtacgccagataatcctttatggttcttatgcaaggggggacttccgcccggattctgatgtagacattatgatcctggtggatatatcagatctggaattaaaggcatatgcacaacagctctcgtacatgacctatgactttaatatggatcatgacatggacataaagcctattgcaaaaagtgaagcacattttaacaagtggattgtgaactatccattttattccaatattcataaagaaggggtagttttgtatggagcagcataatcaggaatcggtactaggcgggatctggtgttatatcgtcgggaaacagcccgaaatgatctgaaatcagcaagagcattattttttattgaagattataaaggagctaataacagagcgtactattccatctttcatgcaattaatgcagtacatgctgttagcggtaaagcatataaaagacataaagatgctgtggcaaacttcaataaggattatgtgaagacgtctgtgtttccaagggaaatgggaaggaaaatcggtcaggcagaagagattcgccatgccagcgattatgatgatttttatattgcaagtaaagaagaatcagaacagcagatttcagttgcagatgaatttataattctggcagaaaaatattgtctggaacagcttgaagaacaaaaggaatactgaaatgaacgaggatgaaaagataacgatattcagagaactggtgaaatcaattaaagaaaattcaaaatatctatcagaagacttcgatccagatacagagctggaaaagggaaaaaagaaaaatattcagaaatagttttttgaataaataatatagaaaacgtataaagggcgtgtgaaaaaacgagagttttttcatgcgtccttttgcttatggttataataatagttatattgcataaaaaagggtacagttccccttaccccataagaatgctattatgaactcctatgcggcagctacaacttttttctgtttgttgtgatatttataaagattgtgtccgatagaaacgagaaatacttcaagcaatacagattttattcctcttcggacaattcttttgtaccaccggtcgtttttcatgataccaaaggtaccttctgcctgaatggatctgttcatccttagaagcgctccctggatactttcgagattttctatcacttcctgatgcatcgctgtaagttcgcggttgatccgaacagtacggtttttgtctgtctttttacattgttctgcgtatggacagtcggagcagtcttcacactgatacacttcttcctgtcgcccatacttgttcccttttacgttttttcgatactgaagataaaagtttttcctgtttgggcaacgcatgattccgtcttccccgattggaaaatttactgcacgaaatggatcttcatggtatttcttgtcagtagtttctttcttgaacatgggaaacttcatatatttttccattccttgctgctcacagaagatgtaattgttgtaagaaccatatccggcatctgctactgggtacttcggatagaagccatatgtagtataaaacttgttcattaatggaataaaacaatccatatctgagcgatactgatttacatcaataacagcaatgtattcatctgcaacaccgacctgtacattataagctggaagcaactggtcatttcccatgtagtctgtcttgattcgcataaaagtggccgaatgatctgtttttgagtagctgttgcgatcttctccacagattttgattttttccacgtattcttccaacttagcagcataccctttgagtttctcataatgacgttgctgtgtagttttgcgatgtcccctaccatgaacaaacattgcttcattaatctgccagacttctgcatactgttcagcagcttccttcagatactctagtgcgtattcactattgatacaaagtttcatacctgtacatgaaagttcctcattgatttctttaaaaagtgtagtgatcttatcaaagagacggtatctggatttttcggttgcttttttccatacccaggagtatttattcgtatttgcttcaaacttggatccatcaatgtatagatgttgaagatccacatgttctgtctcgaagatttttttgtttatgtcttgaaatatttcttcaatagaatcagcaagaacttcgttgatgaagtagccgaaagtgcggtaagaaggtgcttgatgatccataagatacatgaagcggagattgactttacattgatcctccagttcacgcaatgatatatagccattcgccataaatccaaacaaaactgttttcagcatgctgaccgggtcatacctgagtcttcctgtgtcatgttgaggaatatttttcagatatttctccagttcgatttctcccataaatctatcaaaagtcagcactggatcacagatgtccaaataatcttgaattagcattggcaaaactgcctgttttgggttagaatagattatgttattaattttcattgcaagttaattataacagaaagaaagaccttgagttcattataaactcttggtctttcttttttggggggactattcttttttcacagcccctttttttactctgaatgatatactgtaaaagcaagaataataaagataaaaacactttttttacgtgtagtaataggcagtatttacatatccacaaatttcagaataacaaggagaaacgtatggatcatttcaaattacactccgaatacaaaccaacaggcgatcagccccaggcaattgaaaaactggtcaaaggctttcaagaaggcaaccagttcgagactttgctgggtgtcacaggttccggtaagaccttcaccatggcgaacgtcatcgcccagttaaacaagccaactttggtacttgcgcacaataaaacacttgcagcacagctgcacggtgagtttaaggaattcttccctgagaacgcagtggaatattttgtctcctagcatgagaaagtcacaaaacaggtggtattttgtggtatgtgggtggttgaacatccagatgttgtggaagcggtagtggtgagagtataggtgaaaagcgggtggatgaagaggttttgtgactttatatcatattatttttaactatagtatatggagaagagattgtttataaaagaatatcgctagataccttttaaaacatgtaaaatcttgcaattgcgagaatataatagtaagataaagaaaaagaaagagagggataacgatgttagggtataatgtaattgatatatcatcatatattattgaatattcaaatgaaatcggtagcccagtaagcaatttgaaattacaaaaattactatattattcacaagctgcaatgttggttgaacttggacagaaatgttttgattcaaaaattatggcatgggaatttggcccggttgtagttgaagcgtatcaacattacaaggaatatggaagagatgttatttcgaatcaagaagattgtaaaagaatgaaacttgatggaaagacaatgaaaattatttatgaaccatcaaaaaaaattgataatgtcacaaaaaaaataattagtaaagttgttgattcttattcccaaataagaaacccatttgaattagtaagaaaaactcacgaagaagatccttggaaaaatacagatttaaatcaagagatagaatgtgatgaaatacgtaaatattatgaaaaacaaccggaaaagatatatggggtataggaagtgcagtataataatactaaagatacagaaaaattattaaaaatattttattctgatgaatatggctttgaagaggaggaacttagtaaaagtttaaaagaggttgtgaaatattatgataagcatacaagacatcaatatcatattatttctagatttgttaatgaaagaatgcaggaaggtgaagatgctgtaagctatatattaaataatatagatgctatgttggcctttttagaatatagacgagaaaattgtgaccaaattataagagagtcatcggatttagagatagataaaataatattgaatttggaaaaattatatgatcatattgcacttgaggaagaacgcctgaaaaataatgcagtaaatatgcgagtcagtaacaatcaaatacaaaataatgtaatgaatacttttaattcgataatggatagctttcagggaaaagtggatgaagtttcaggatctttgaatgcaaatataattactgtagttggattattttctgctattatatttgtcttttttggtggcattacgggaatgtcagcattggtaaaaggtatttgtgagttaacaaataaaaaagagttgactataccattaatttgtgtctgtgcagttggtttcgtgatttttaatatcgtatttttgttattatttcaaaaattgttgataaaaatataggaacgacagttaatggaagagagtatgtttggtatgatattgaaaaaaaagatgaaaattgttatgaaataataaaaaatgggaagagcacaggaaaatattgtaatacacaacagaaagtggaaaagaaaataaaatggaaacaaagatggtggaatataagagaagctgtctttatgtgtataaaaaaggttttatttagatttccgtatgtgttaattgtaaatattatatttgtagtaggtattatatatctttataaacaactataatagatacattttatagtattgttcggatatatgtacaccaaatacattttgaattatacatagccgattggttcatcgagaatcaatcggttttttcatgcccatttttatacatagccagtcccgtaaaaaaggattggctattaaatttttcgaggaaggaggaacctatatgaccaagtgtaaagtaatcgcccttgcaaatcagaagggaggaacagccaagaccacaactacattaaatctgggaattggtcttgcacatcaggggcgaaaagtattattggttgatgctgatccgcagggggatttaacaaccgcattaggatggaccgatgcagatgatcttccggttacattggcaacacaaatgaagaagatattacaagatgaaccatttgtgtataatgaaggtattttgcatcatgaagagggagtagatattattccgactaacattgaattatcgggcatggaaatttcactggtaaatgctatgagcagagagcagactttaaagctgtatctggcagatttgaaaaaggattatgattatatcctgattgattgtatgcctagtttgggaatgttgaccatcaatgcgttagttgccgcagatagtgtaattgttccagtgcaggctcattatcttccactaaagggcatgacacagttaatgaaaacaatcggtaaggtacagagacagctaaatcctaatctgaagattgatggagtattgctgacacttgcagatatgagaacaaaacttgcaaggacaacagagactagccttagagagaattatggaaagcatattaggattttcaaaactgttattccagtggctatcacagcagcagaaagcagtgcagcaggacagagtatttatgagtatgacaagaatggaactgttgcaaaggcgtatgcagaatttacgagggaggtgattcaatgtggcgaaaagcagagaaataaacatgaatcttccctcagccgatgatctttttacaacgcaagaagaaagagaccagaagaatcaggaatatgtaaaaaatatttctatttatgaaattacagacttcccgaatcatccgtttaaggtaaaaatggacgataagatgttggaaacaattgagagtgtccgtgctcatggtgtattagtgcctgcacttgtcagggagaaaccgacgggtgggtatgaaatgatttccggacatcgcagaaaaatggcaagtgaactggctggaaaagagacaatgccatgtattgtaagaaatcttagtgatgaccaagcagtcattgtcatggttgacagcaatcttcagcgagaagaaatcttaccatccgaaaaggcatttgcttataaaatgaagctagatgctatgaagagacagggacagagaacggatttaacttctaccccactggggcagaagttaggaaaatattccgtagaagttctaggagaacaggtaggagaaagtaaaagtcagattcaaagatatatccgccttacggagcttatcccggaaatcctagaaatggtcgatgacaaaaagatttctatgcgtccggcggtggagctgtcttatttgccgaaagaggaacaggagatattgtacgacaccatggagtcggaggcttgtaccccaagtcatgcacaggcaattaaaatccgcaaattttcagcagagggcaggttgaatgaagatgttttgctgtcgattatgtcagaagagaagccaaatcaggtagagcagtggaaaatcccaaagaaccgactgaagaaatatttcccgtcgggaactacacagcagaaaatggaagaaaccattatcaaagcactggaattataccggaaaagggaaaaaagcagggaacgctaggtattttgacaccaagggaaaagtctatccttttgggtataacgagaaatcagtctattcccgctttcccctccccacaccctacccctttggtttaccagcagattaccagccgaaaagacaataaggagccgggaacattttctctttcggcaggtcagagattcccacaccctgcatgacagcagggaataaacagcacaaagcaacaacaggcgttccagacggacgtctttttttgattgaaaagaaaggaattgtagaaaatgaagaagatatggaaacgagtgtgtacaggacttcttaccctgaccacgattttaactgcattaccgactacatcggcttacgcagcagaaatacagtattggacagagtcctcagagcgagtcggatatattgaacatgtgatgaatgatggaaccattcattcgacattcaatgaaggtcacatgaaagtggagggcgaaacagcctattgtgtagatattaacaccggatttaaaaatgggtataaaaccagacacgatgcgagttccagtatgagtgctgcacagatcgaagatgtggcattgtcactggagtatgtaaagcagtataggggcagtcacagcaacctgaatgcgaatcagggatatctgttggaacagtgtgtagtatggcagagactgagtgagtatttaggctggcagtgcgataatgtacgagctgcatattctgagatttcacaggatattcagaatgaagtgtatgcaggagcgagagcatttgtacaggcgaacaaaggtcggtataaatgtggaggatatatatatactggagagggacaggatctcggacagttttgggcagaactgaatgtcggaaatgcaaaagtaaaaaagacaaccgcaaatgagattatcacaaatggaaatgcgatgtataccattgccggagcaacctttggcatattctcagaccagaattgcagcaatcagattggaacacttacaacaaatgagaatggtgagacaaatgaggttgaagtgactgcagggaatgtttacatcaaagagctttctgcaccgaagggatataagctggatacgacagtacacagtctgaaggttgaagccggaaaaaaagccgtattaaatgtttccgatgttccgaaagtgacagagacactggtagacctgttcaagattgatatggagacaggaaaagcaaccgcacagggtaatacagcactggcaggagcagaatttacctggcattattatgacggattttatacaaaagataacttaccagagaaagcaacacgtacctgggttacaaaaacggtggcagaaaagagcagtgacggaagtattcattatgtgacaaaactgtcagatgcttacaaagtatcgggagatgcattttacattcagaatgaaaaaagtgtattaccacttggaacactgactgttgaggagacaaaagcaccagacggatatttactggacggagcttatatgcaggcaggagacagtacagaacagataaaaggaatgtatctgacacagatcacagaggacggagaacttgcagttctttccggaagaaaccagtattccgtatctgaccaggtaatccgaggtggtgtgaagattcagaaacgtgatttagagacaaaagataccaaagcacagggaagtgccacattaaaagatactgcatttgcaattatttctttgaacgaaaattcggttctggtagaaggaaagctatacaaaaagaacgagacagttaagacgattcagacagggattgacggaattgcaacaacgacggcagatttacttccgtatggtaaatacaaactggaagaaaccaaagcaccggaaggttatctgactgacggggcaaaagcgattgaattttcgattacggaaaatggaaaaatcgtagatttaacagacgaaagccattccatttacaaccagattaaacgtggagatttagaaggagtaaagattggagcaggtacacataagaggcttgcaaatgttccttttaagattacaagtaaaacaaccggagagagccatatcgtagtgacagataagaacggtcagttttcaactgcttccaattgggcatctcataagagaaatacaaatgccgggaaatccagtgaggacggaatctggttcggaacttctgagccggatgacagtaaaggtgcattactttatgacacttatgagattgaggagttagcttgtgaatccaacaaaggtatgaaattgattccagcatttgaagttgttgtcagcagaaataaagtaacaatcgaccttggaacactgaccgatgagtatgaaaaagagattactattcatacaacagcaacggataaagaaacgggcgaaaaaataattgttgcaggaaagaaagtaacgattgtagatacggttacgctggacggtctggaagaaggcagaaagtaccagttaaaaggctggcagatgctgaaagaggaaaatgcagaactgctcattgatggaaagcgtgtggagagtgattatacctttgttgctgacaatgaaaaaatgaaagtagaaatttcttatatgtttgatgcatcagaacttggcggacagaatctggttacatttgaagaattatacgatctgaagaatccggaagaacctaaaaaagttgcagagcataaggacattgacgatgaaggtcagacagtcctgattacagagcgaaagatttcgattcataccacagcaactgataagaatggaaagaaagaaattgaagccggaaaagatctgacgatcgtggatacggttactttagaaggactggaaattggtacaaactataaattgtctggttggcagatgattaaggaagaaaatgcaaagctgatcattgatggcaaagaagttaccaatgattatgaatttacagcggataaggaaaacatggaagtgcagatcgagtttactttcgacggcagcactcttggaggaaagcagcttgtaacctttgaagaactgtatgatatgacaaatccggaagaaccgaaaaaggtaacagagcataaggacattaacgatgaaggtcagactgtaaccatcaaagaagtaccggaaacaccaaccccagagacaccgggtactactacaaaaaccagtaaccctccgaaaccagtaaccctccgaaaacaggagacactgcaaatgcaattttatggatagccatcctggtattatcagcagccggaatcacaggagttcgtatctggaataaaaagaaacaggttaagagattaggaattgaagaaaagaaagaagaggaggagtaaaacagagggcggcgataagctgccctttgatgatgaaatgggaaaaaatcagaaagcaataaaagtattacagcgtttatttgatgccggatacggaacggaaaaagagattgtcaatatggcgatggatgaaatgcttgctttgccgggagtgaatgtagcagatctgtgcattatcagtgagttgcagaaaagcattaaggcaaacaaagtgataagctatttgtcagggaaaaaagaagtaaaggaagaaacgaaaggagcagattatggtggaacaacctaaatatttggaaatgacattatcacaattgaaatcatatgtggaatcttcagagagtaatatttttttggttgtagaatttccaaaaggagatcagaaggatggagaatgaattagaagttgtgaatatccgtctggtaaaagaaccatctctttatagtgagcagacattggacagtccacaggctgttgtagaattgatggggaaggagttatcgcaatatgacagagaggtattttgcatcttgaatatgaaaaataatggacaggtaatcaatatgaatctggtcagtgttggaacaatcaatgcctcactggtaattccgagggaagtctttaagagcagtattctggcaaatgcttctgcaatcattggacttcataatcatcccagtggtaatgtgaaaccgtcaaaagaggatatgatcgttacgaggaagctgcagaagtgcggacagctactggggatagaattgctggatcatatcattgtcggcggaactaatggaaagatgctcagtttccgagaagaaaagatgttgaatgtgacaggaaggatggattgggagagatagaagaaaaaagaattagaagtttttatttattgtaatatttcatgtagcggtattagtaaaatagtgtcgctacaaaaagctgacttatacattgatattatatgcataactcaaaataaaattgttaaaaatagaaaaagaaacaatatataacgaaaaaatctctaaataagaaaatttgcattgactgagagaagagtaaaacatataataaaggtggaggtgtataagaatgttagtaaaagtaagtgttgaaaattttaaatcttttgataaagcagcagagctgacaatgatttcctcaaataaaatacgaacaaatgcaaatcacaggttaaagataaaaagtacccagttattaaaatatgcagtcgtttatggagcaaatgcatctggaaagaccaatctggcattgttctttaaattttttaaagacagtgtctgcaatggtattccgatagaagctacacagatgttttgtaagaatcggcaggagaataaggaacgagaaagtagttttgaaattcagattactgtaggtgacaaattttatgcctatggtttttctgcagttttaagcagacgaaaagtaaccggagaatggttatatgaattatatcagaacggttcagcaaaatgtctctttgaacgagaaggaagtaaacgtccggtgttaaatgagagcattactttgacaaatacagaaaaaaacaaatttgaaacttatgcagatgactttgaaggaaatgaaacatctttgttcctgacggaaatgaatcgtgggaaaaaatatagcacacgatcaaaattactgttcttccgggatgtatatgactggattcagaatcatatttcgattatcacaccggataccccgttgattgatctggagtactactatgatgacaattcgttgaagctgattaataaattgatcaaaacatttgatacgggtattagtcaggtaaaaatcgaagaaattacattggatgagttatcaaatgcattgccgaaatcagtatttgataagatgatgcagcatgtaaaaaatagaatggaagagcaggaagaaccatcattcagaatgacgatgaggtcgaaggaaactttctttaatatcgaagttgaaggacattctgaaccgaaggtcacaacaatccggttgcatcataataagtcattttatgagttcggttttgacgaagagtctgatggaacaagaagattattcgatttgatggatatgctgttgaataaacgagaagatgttctttatgttgtggatgaattggagagaagcttacatccgaagctgacagaacgatttttgcaattgtttatgcagctacatgatgagcagcgtatgcagctattgttcactacacatgaatcatccattatggatcaggctatttttaggagggatgaaatctggtttgtagaacgtaacgcagaaaatgcaagctctatttattccttagatcgtttcaaggagaggtatgataaagtgttgagcaaggcatatctggaaggcaggtatggtgcgataccagtattttcaacatttgactttagagaggaggagtagccttggctccagtaagaagttatacgaattggaatagtagaactacagatgaagaagaacagattgagccttatcgtaagtactttttcatatgtgagggtgcaaatactgaaacatggtatttcaaaaagttaattgatatccgaaaagagttaaatattcatccattgatcgatatccggttacttgaaaaaacagagggagacagggacatttcatttccaagacgtttgattgagtttgcagaaaatcagaaagaaaatccagaaatagcgtttgataaagaacgggataagatgattgttgtatttgatggagacatttttgaagagaaggtacttgattatgatgaattggtagcagaaggtgaaaagaataatatattagcggtcagcaatccggcatttgaattgttcctgctgttgcattatgaaaactcatacgaagatgacattgagccaaatgctgaacagattatccagaatgaaaaagatggacatcagacatttatctataagttgttacttgccagaacaggaatcaatccaaagaagaattcctcaattggagaactggcgaagaatatagagattgctattgaacaggaaaagaaaatcaatgaagatattcatcagtgtaaaggacagattacgtgtaatataggtcggattattgatgagattcggaaagatgatggaaaataaatatggataaagcggagaagtgtttagaaagaagaaacaataaaagaaaaatatattacaggacagaaaaaggttataatcttgtgaaccaagcccaagaaatgatcacaagagaacgatgtgtagtattggatgaaaagcagatcttaattccaggatgcgaaatttggtttacagatggtgaagtgattgatgcatttgcaactaaagaaaatgaaacgtactatatgttcataaataaagccattatagaagaacaaaaagagtatttagaaaaattaaattggaaatttttaattgattcgggaataaaagaagaatatatagattcacttatagaatatggactatattttgttatctttcatgaatacgctcatattttatgtggacatgtcgaagctaatttggaagatcatgaggataagaaagcagaagagtgtgaagcagacatgttttccatggattatcttattaattttttgcttcatacaaaagaatcaattgaatggagttcggagattgaaaaattatttttagcaatttattttatgatggaaaattcccaagcaaatgaatatcgagaattctataatgataaattaattcaaaactattatgatccagaaagaattgagaaaagagatcatccgttaaatgcacaaagaataatttatttatatgaaatgttaaatattctaattgtagatgagaaagttcaattattgccaattagagagggtataattaataaattaaaaattgtaaaaaacataagtgagaacagagattccaatgttaaaaattacaatgtaattaatgattctattagacagttgaaacagagtttgattaatattcgaaaaaaaatcccgcgattaacggattgattttttgcgaatagatttaaaagttgaaacgaataggaaaagcatacatagccagttggttccaactcaaggaatcacctggctattttcatgcctgggtattatcccgaataatatcaatctaaggcaagaaaggagatgaaaattatgccatatataccaccatcggtcgtgcgggaggtcaagcggatggatttgctcacgtacttgaaaaattatgaaccatacgaattggttcacttttctggcaacacctacactaccagaacacacgatagtttgaaaatatcaaatgggaaatggatgtggtggagtcagagaaccggtggcagatcagcactggattatctgatcaaagtaagaggatacagttttttagaggcggttgaattgcttgcagaacgggcaaatattcagccgtctctttctgtatctgagaatgttccgatggagaaacagttactgttgccaaagaagaatcaagatgatcagaaagtgattgcgtatctttcaggacgtgggattgataaggaaatcattcagttttgtttagagtccggaagagtttatgaaagtgcatttcatcacaacgcggtgtttgtagggatggatgagaaagataatctgaaatatgcagccattaggggaaccggaacaagttttatcggagaagcaaatggaagtgataagaactattctttttccattttcacagagaaatcatgtgatacgatgcatctgtttgagtcagctattgatctgttatcttatgcgacattgttgaaattggacgggaaggagtggagaagagaacatttattgtcactggcaggtgtctatcagccagcaaaagaaattgaaaaaagtaaagtccctgcagcgttggcaagagcactaaaaatgcatccagaggtgaagacaatcgttctgcatttggacaatgaccgtattgggagacttgccacaaaagcaatttctgcagtgcttccaaagcaatatcaggtaaaagatgtaccgccaaaacaaggaaaagattacaacgatctgctctgcatcaagttaaatctggcaattacaaagcgagaaaaaagcacgaaaaagagtatgtctggtcatgaaaatatgagagatagaaggtgaaaaagaacatgaaaattgcaaaatatgagctgaaggtcgtgcataagaaaaagctgattttgacgatggaagacgatgtggacagtgaagaactgttgaagatttttctgaaaacacagttgaaagaagaaaaagaacagagtgaattacttggaattattgctgagaaagtgtcagaagaaagctgtacagagcagtgtgaaagttgtcaaaagtattgtccggcaagtgaagaatgtatggcaactgatgaaaatgtacgatgaacaaagtgtgaatacttgtgtgaagcttgcgggatttgtgaactgaaaaaataaaaaaagcaagtgttttttcggcaagtaaatcttctgatacccggaacagtgagacgggtgcagaagaatacacaataccagcaagcaacgcctttggattaccacacagttttcctgtctggcagtccggcggcagcttgtcagggagaatccctgaaaccctcagaaaatgaaaaaggagaaagtaacaatgttgaagtttatttgtggagtattagtaggtggcattataggagtagtgttgatgtgcctgttacagattaacaagattcagtagacaaaaagaaaggagatacaagatgctggttgaagtatcaatgaaagacaagaagaaagcagaaagacgatatcaggaatatttaaagaaaatgaacaagaagaagggagaacagaagaaatgattgcaaaagaaatgatagcagaaaaggtatttgcggaaggtgtagcaaaagacatccggaattttcttccagctaaatatgagaatgcagaatttcaggtaatgcagatgaataaaaataatggagtccagatggtaggagtccaggtaagactgcaggaagaaaatgtgtgcccagttgtctatgtagaaccgttcttcaatgaaatacgtttgggtgaacccgttgagaaagtgatgaatgaaattgcaagatgcatggaagaagcaggcaatgctccgtttgtgcacaacggtatcaacccaatggattatgattcagtgaaggaacatctggcagtgatgcttgtaaacacccaggcaaacaaacgaatgttacaggaaatgcctcatgaaaatatcgaagatctgtcggctatctgttatgtggattttccggtagagtctaacgatggaaaagcgactatgaaggtgaaaaatgaacatcttaagatgtggaatgtggatgcaaaagaaatgttccagcaggccagagcaaatacacagcctgtaaatacaccgattcttcagtcaatggacgaaatgttgttgagtatttttaatgaagaaggacatgcaacaaacctgttagatgaaaatgttgattttggacttcgttcacatgatatgctgtatgcacttacgaatgtagaaaagcaatatggagcatctatgatcacgcagccagaagttttaaataaattggaacagctttttccagaaggattttatgtgttaccgtcatctgtgcatgaagttctgattgttccggataatggagagatggaaccgaaaatgcttggtgaaatggtacgggaagtaaataaaaatgaagtggaacggcaggaggttctctcagacagagtttacagttacgataaagaaaaacaccagattcgccaggaaccagattctatacagaaagtaaaggagatggagcgttgagaaaacgtaatgtagcaatccttttccgattgaacaaaaaagaagcagaggcattggataagaaagtaaagagaagcggactgaaccgggaagcttacctgagacagttgatttctggtgttgttccaagagacgcaccgccgccagattattattctatgatgcgggagctgcataagattggaaataacttaaatcagatcgcacagaaagcacatgtgttaaatgtggtagatgtgcagcgttacgataaggaagtgcggaagttcaatgaagcagtccgtaagattacagaagcagtgatacttccagagaaaaatgaatcatggcagtgacatcaatctggagcatcaaggggtggattggaaaggtaatcaattatgcggagaatccggataagacgaaagagaacaatgaagggcgaatatctgagaatcaatcacgatccacacaaggacttaatgatgtaattacctatgcggtgaatgcagaaaagatcagacggaggcaatttgaatctatggaaatggaacttgtcggagaagcggaagaactaatggaacagtatgtatctggagtgaattgtgcaccgacaaccgccagagaagaaatgattgcggtcaaaaagcgttttggaaaggaggacggaattgttgcgtttcatggctaccagtcttttgcaccgggagaatgtaatccggcaatggcacatgagattggaaagaagctggcagaagaattgtggggcagtcagtatcaggtattgattgcgactcatttggataaggcgaatcatctgcacaaccattttgtggtgaactcagtttcattcattgatgggaaaagataccacaggacaaatcaggattaccgggatatgcggatggtgtcagaccgtttatgtaaagaataccagttatcggttgtgaggcagccagaacagggaaaaggaaaacattatgccgagtggcatgcagaacaggatgggaagccgagttatcacagcatggtaaaagcagatgttgacgaggcaatccgaaaggcgaggactgaaaaacagttctttttttatttgcggggaaaaggatattcttttaagttcgggaaagacattaccgttcgtccggaagggcgggagcgtggtctgaagttaaagcggaattttggagagaattattcactggaagcaatccgggttcggattctggaagaaaatgaattacctgccgagaagaaatttccggttcagaggcattaccggattcgggtatccggcaacttcaagcagacaagaaaaatcggaggacttcggggattgtatctgcattactgttatcttttaggaatcctaccgaagaatcgcccgtcaatatctgctaaacaggtgcatgtattgttccgggaggatttattaaaactgaataccatttccaaagagacaaagctgctctgccattatcacatagatactgcagagcagcttttttcgttgaaagaaagtttgcagaagaaaacggagcagtgtgtggaggaacggaagcatctgcgttataagatccgggcagacagaccggaagaagaaatacaggaaatgaaagagcagataaaagttctgacagagaaaattggaacgctcagaaaggaggcagcactttgtgatggaattgccgcacgttccaaggtgatcgaagaaaaatttaagatgatgcgggaagaaaaagagaagaaggaggaacaaagccatgaacacatcaggcgaagccgctgatcaggtagtacgaatgtcgttggaagtcggtgaagcagcattgaagatcagtggtacaggtgcgaagcatctggcagtgatgctgtatacagtcttaaaagagaagaaaaagacaaaaggcagagtaagacttgaaacattggttaaatcaggtagaccactgacggtattttcggtgaaagaaagtgatctgaaacaatttgttcaggaagcaaaacgatatggcgtgttgtactgtgcagtccgaaatccaagaggaagcagtgacggattggtagatgtgattgtaaaggaagaagatgcaccaagaatcaaccgtatcgtagatagattccagtttgcatctgtaacagaagcagcgaagattaagacagaaattgagcggacacgtgcagaaaaagcaaaagccggaaaatcagagaagcaggaaaagaagccggaaaaagtacaggttcagcaagaaaaacagggacaggcagagccggaaaaagattatccgcagaaatccaaggaggatcagcttatggacgagttgtttagagagtcggtgaagaaagagggtaaggagcaaaacccctctttggcaaagacgaccaaatcccgtctgtccgagcctacctcaaagaagcaagagaaaaccgcagagggtacttctaagttatttaccccggaaaaaccagagaaaccatcggtcagaaaggaacttcgggaaatacagaatgcaaggaagaaagaagcggagcggcgtgagaatagaaatgatccggtgagaaatcagggaaataaagaccggaatcagattcgccaccagcagccacaacagaaacgaaaaccaaggaaagggaaagagaggtaaattttatggataatagttttgattctttattaaatgcatcggctgtaccacaggatgaaaaggtacaggcatttattgcggaaagcaaaaataacaggaatcgctgctatgagttgtcagagcaggtaaccgcacaagtggcaacggatgggaaaatgctgcagaagtatctggatgtacagagtacctttgatcgttatactaccaataatgcacttctgattctggcacaaagaccagatgcacagaaattaggtgactatggatactggagagatcatggattttatttaaaacgtatggaacgacagaatccagttctgattttagaaccgggaaaaacatataagcgtgaagatggtacagttggaaattattataatgcgaaaaagctatatgatatttctcagacaacaatgtccgatactacaattcaaaagtcagaatatgaagaacatgatttaatccgggcgttagtcagtacccctccggtaaatattgttgcagcagaaccagaacagatgccggatgaaaaaggagcatttttcaaaccagaagaaggctgcatttatgtaagaaaagggatgagtgcacaggagatttttaagagtcttgtgccggaattggtatttgccggatatgcggatgggaatccgcactatgataaaaatgaagatgcatttcatgtatcgtgtgcgtcttatatgttgtgtaaaaaatatggaatagataccagtcgatatgatttttcacatgcaccagagttctttgaaaaaatggagactcaggaagtgcgggcggaactttccagagccagagatgcagcgaatgcaatttctgcaagaatggcaaaggtactggatcagaatcgaaatgcaacttaccgacagtcagagactgaaagaccagaacaagacagtcctgaaaatgagaaagccaagaaagaaaatccagagccagaaaaaaaggaaccgaaatccagaggacagcataggaaagaagcacgctagaaaaatttgggaaaggagaatgcaaaatgagcagtgatacgattacgttagaactggataaatatgagagtggcgtagtgttccattccctaaaggacaagcggaatcagatgctgaaagagggaaaagatacggagcttgtcgatgatgttttaatgaaagtcattgagaaaatcgaagtaccgtcggagaaggaaaagcgaggacgcagaagccatgaagaacgatgatgagcagagcagtctgatggtggcggtaattggaattatcccggttatctggtttgcgttacttgtcgcaccttatctttcgtctggtcttatggggattctggatggagtcccggaagcaatgaaccatccgttttccattcggttatgtggggacagtgtaaaaactgtccttatttttttgctgtcttacggcatgggaatcgggatttatatttctaccaagaaacattaccgacgaggtgaagaacatgggtctgcaaaatgggggaatgtgaagaaaatcaatcgcagatacagggagaagcgatttacaaaaaataagttgctgaccatgcatgtacgaatcagctacaatatgcggaaacatttgcgaaatgtattgacagttgtgattggtggttccggttcaggaaagaccagattttttgcaaaaccgaatctgatgcaggcgaatacttcttttgtggttttagatcccaaaggggaaaatctgagagataccgggtatcttctggaagaaaaaggttatgaagtaagagtgcttgacctgataaatatggaaaagagccattgctataacccgtttgtatatctgaaggacgataacgatgtgcagagactggtaacgaacctgttcaaagcgactacaccaaaaggcagtcagtctaacgatccattctgggataccgcagcttctatgctgttgttggcactgattttctatctgagatatgaagcaccggaagaagaacagaatttcccgatggtaatggaaatgttacgtgccggagaagtcagagaggacgatgaccagtaccagtcaccgcttgatgaattgtttgagcggttggaaatgaagaacccggaacatatcgcagtaaagtattacaaagattatcactctggtagtgccaagacattaaaatccattcaaatcacattagcagcaagacttgaaaaatttaacttatccagtctggcagcactgaccgcaacggacgatttagacctgccatcactgggagagcgaaaagtggctttatttgcgttaatcccggacaacgacaccagttacaactttctggtgtcaattttgtatacccagttatttcagcagttgttctatctggcagaccataaatacggcgggagacttccggttcatgtgcatttcctcatggacgaatttgcaaatgtttcactgcctgatgacttcgataagattctgtctgtgatgcgttccagggaagtgtcagtcagtattattttgcagaatctggcgcagttaaaagcattgtttgagaagcagtgggaaagcattatgggaaattgtgatgaatttttatatttaggcggcaatgagcagggaacacataaatatgtcagcgaacttcttggcaaggcaacgattgacacgaacacctatggaaagtcaacgggacattccgggaactattccaccaattatcagaatacagggcgggagctgatgacacccgatgaagttcgcatgttggataaccgatatgcgattctttttattcgtggagaaagaccaattttagacgagaaatttgatattttaaagcaccccaatgtgggacttacaactgacggaaacggaaaaccatatctgcatggagcagttgaccgggcagtggcaagtatttcactgggagacagcttggaaggcgagttcacagatgattctctggaagtggaagattatgaattattatccgatgaagatctggaagaaatcattcagaaatatcagtaaatccaagaaaaatatataggaggctatcaaaaaaatgaagttagatatgcgaaagaagcaggagaagaaagaaacaacaaaatcaacgaagaagctgccaatgacagcaaaaatgaaacgtgccatggcagtgtatattgcaatggtactgattatgacagcaggagcaagtaccgtatttgcggcagacgatccactgaccgttatcaataatctgtccacgtttatctttggactgattcgtgccatcggaatgattttgttgggatttggaattgtgcaggtcggtttatcactgaaatctcatgatccaagccagagagcgaatggattcctgacacttgcaggcggtgttattattacatttgcaaaagaaatcctgaatctgattacaggttaagaagaataggaaataaggaaacgggacggtgcaggtccgaaaggaatcgcaccgcccaggctaagacaggaggtgtttagaaggtgtcagataactgggtagtacagaacttgcaaaatgccttggatacctggaacagcaaacttgcagaaatctggcagatactcacacagtcaccggaaacctttaagggtggcggtatctggcaggtgattgtgcagatccatggagcattgcaggcaatcggctatgctttgttagtgcttttctttgtagtcggagtggtcaagacttgtggaagttttacagaggtaaaaagaccggaacatgcattgaaaatttttatccgttttgcgattacaaaaggcgtagtcacgtatggactggagctgatgatggcattattcaatatcatacaaggagtgaccagtacgattatgcagaccgcaggatttggaagtacggaagataccgttttaccggacgaaatcatagaagcggtagaagattgtggattttttgaaagtattcctctatgggcggtgacgttgatcggtggactttttattacagttctgagcttcattatgattatgagtgtatatggaagattttttcgattgtatctttacacagcgattgcaccgattccattatcttcatttgcaggagagccgagtcagaatatcggaagaagttttttgaagtcatacgcagcagtgtgtctggagggagcaatcgtggtacttgcctgcattatattttcattgtttgcatcatcaccgccagttgtcaatccagatgcagcagtagtcactatggtgtggagctatattggagagttgattttcaatatgcttgtactggtcggtgcggtgaagatgtcagacagggtagtgagggaaatgatgggattataaaaaacagagtatgtatggtaagaaaccgtacataccctgttgtatgttatgagcctattctacaatgtctttgctgtcattatatctcatatttccctgagaatcgaaatgaacagaatctaatggaatccctctttgtctggcacgagaaatctggaaggacatatcgtctttcataactttgtagtattgatgttcctgccatttgcgtcgcagagcaaaaatccagctgagaacagaaaaggcagtcagcagatagaggattgcaaatgcaagtttctcatgagttgctgcccatggattcagaattgtggaaacagcaagaaagtataacagcggtaaggtcagatttaatctggcagcaatccgaaacagcagagaaatcaggaatagagcaacggtaacaacaagtgaaatcataacagtgattggcataggtcagtcccccctttcatttacccaaagtgtaacagaacagaaaaaatataacaaatgtgcgatttggaggtgtatcgttttggaagtaaaaattaacaaggaaatcagggattacacggaagcaatctttttcggattgtccctgagacagtttatcttttcaggattagcctgcgggattgccgttgggctttattttttgcttcacccatacatgagcatggaaacagtgagctggatttgtgtactgggagctgccccatgtgtagtgttcgggtttgtaaaatatcatggaatgacagcggagcagtttatctgggcatggataaaatcagaaatcctgatgccgaaaaaactggtgttccggtcagaaaatctttattttgatgcggtagaaccagtcattaaaaaatatgagaaagaaagtctgaagaaggagggacgcaagaagaatgataaaaacgctgagtaatattttcaagcaggataaagaaaaatttgtaattccaagaagcgtacagcaggtaattcccatcgagactatctggtcagacgggatttttaaaatcgggagaaataaatttgcacgtacttataaatttacagatatcaactacgcggtggcaagcaaagtagataaggaaaccatgttcctggaatatatggatttattaaattctttcgattgcggtggaacaacaaaaataacgatcaataatcgccgcttgaataaggtggattttgaaaaagcaatcctgattccgatgcaggaggacggactggatttatatcggaaagagtacaacaatatgcttttagataaggcaaccagttccaacagcatggtgcaggaaaaatatgtgacagtatcctgctataagaaaacaatcgaagaagccagaacgtattttgcacgagtgacaacagagctgaacagtcattttgcaagattgggttccaaatgtgtagagataaatggagaagataagttacggattctgcacgatttttaccgtacaggagaagaatctggtttccattttgatattcaggagaatatgagaaaaggacacagctttaaagattatatctgtccggatacctttgaatttgaaaaagattatttccgcatgggagatcgttatggaagagtactttttcttcgtgagtatgcttcttacatcaaagacgatatgatagcagaactgaccgacatgaatcgaaatctgatgttgagcattgatgtgattccggttccgactgatgaagcagtacaggaagtggaaaaacgtctgcttggcgtggagacaaatatcacaaactggcagagacggcagaatgccaacaataacttttccgcagtgattccttatgacttggaacagcagagaaaagaaagtaaagagttcatggacgatttaaccacacgtgaccagcgtatgatgttcggtatactgactatggtgcatacggcagaatcgaaaaaacagcttgatgcagatacggaaacacttctgacaatcggacggaaaaagttatgccagttttctgttctgaaatttcagcagatggacggactgaatacagcactacccatcggacaccggaagattccggcagtccgcacactgacttcggagagtgtagcagtgttgatgccattccgggtgcaggagattatggacgcaggtggaatctattgcggtgaaaatgcaatctcccataacttaatcatgtgtaataaagaaaaactgttaaatccaaactcattccttttaggagtaccgggaagtggaaaatcctttaatgcaaaaatgcagattgtattcctggcactggcaacgcaggacgatatcctgatttgtgatccagagcgagagtatgcatcattagttgaagcaatgggcggagaagtggttcgcattgctgcaggaagccgggaccatatcaatgcaatggatatggtagacggatatggagatggcggtgatccagtgattgagaagtcacagtttattttatctctgtttgaacagttggataaaaaaggaatcaatgcaaaggaacgttccattattgaccgatgtgtgggagaagtttatgaggaatatcagcatggcggagcagtgccgactttgcgggtgttgcgtgaaaaatttttagaacaggaagaaccggaagcacaggatttggcactggtatcagaattatttaccaatggaagtctggacgcatttgcacatgaaagtaatgttgatgtgaataaccgtatcatggtatacgacattctggatttaggaaaacagttaaagaccatgggacttctggtaatcactgatgcaatgttgaaccgggtaacggagaactggaaacagggaaagcgaacccatatttttttagacgagtttcatgtagtatttgaaaatgagtattccggagcattttttaactctgcatggcgaagatttcgtaagcgtaatgcattcccgacagcaatcacacagaacgtggaatatctgttagattctgttcttgcaagtacgatgatttccaacagtgagtatatcgtgatgcttaatcaggcagagccggacagagcaaagttggcgacacttttgaatatttctacagagcaaatgggatatatcacaaatgcagatgccggttgtggtctggtgaaatatggaagttcgcttgtaccgttcgtcaatagattcccaaccaatacaaggttgtataaactgatgaccacaaagccgggagaggacagtatcaaccggggaagaatgtaaaattaaaaatattttgaataatgaaaagcaaggcactgaaaatcgtcacaatttgtggcgttttttagtgccggaaaaggagccaaatatgtcagaaatcagattttcatcaaaggaacacgaaaagtttttttatcagatgttagctaaatgcggaaagcacgacagttattacagttcatttttctattgtgtgggaatttctgaagataccagaaatcatgttgatcgcatgtttgattttaaagagcgtttgattaaaccagaagcattgcatgaagggtggcagacaggcggttcggcacgattgaccagactggctttcaacttgtggaatggatatgtggagaagggagaagaaagtctgtctaccccatacgagatgttcgattgtggctatgcatcatatttttatgaagcaatccgcatgaaatacccggaatactgccgggaactgccacaggtgagcaaaaaagaaactaatcatgaacgctagataaagattcaaatggagaaaagcgatggatcgtaagataaaaacacgccaagtccataaggatattaaagtattagataagacagttacagtgacagaccatgttaagcagtcctatgtcagaacaaaagaaaatatcatgcaatcgacggagaaatctagtgatagagagaataatccggtaggttatgcagaagatgcggccagcaagtatgctgaccgcatctttcacgaaacagggcatcaggtacgcagacaggcaggaaagattattgaacggaagaaagagaaagcttctgtttcttcgacaggcgaagaaacagtttaccagccgaaagaagaaattcgaccagtaccgccttcaggcggagaaacggcacaggagcagggaaaagaacttgctgtcaaaaaaattaagaccattgaacgggataaaagaaccatcaagaccgggagagcatcggaacaggttgtaaagaatactggaaaaggtactatcaagacctctggaaaagcggtcaagactgcagaacagacggcaaagaccagtattaagacatcggagcagacagcaaatgtttctgtccgggcaatgcattattccatgaaaaaagcagaaaaagcagtgcaggcagcaagacagacagcacagaatacaaagattgcagtgaaaacgacagcaaaggcagtaacacatgcaataaaagcgttgatggaagctataaaagcattgttaagtggattgaccgcaggcggttggattgcagtggtgatattgattatcgtcattttatttggtggatttctttgcatgacaggcggggataattccagtacggtttcttctgtcagtgcagaagtagaagcatatgagccactaattcggcagtatgcaaaccaatatggaattggtgaatatgtggaattgattaaagcgattatgatgcaggaatccggtgggagaggacttgacccgatgcagtgttcagagggcagttttaatacaaaatatcccaaacagccgaatggaatcacagatccggagtattcgatttcttgcggagtgcaggaaataaaaagctgtctggaacgtgcaggagtaaaaaatcctctggatatggaaaatattaaactggcattgcaaagctacaattatggaaatggatatctggaatgggcgaaagctagaggtggatatacccttgccaatgcagcagaattttctgatatgatggcacagagaatggggtggagcagttatggggacaagcagtatgtaccacatgtgcttcagtattatgcatttggaagaatcccgacaggtatcggcaatcaggcaatcgttcaggtggcagcatcgcaggaaggaaaaggcggaacgacttattggagatggtatggatttggaggcagggtagagtggtgtgcctgctttgtgtcctggtgtgcagaccagagcggttatattcagagtggagtcattccgaaattttctctttgttcggacggtgtgaagtggtttgaaagcaaaggtaggttccgtgacggaagttataccccggtggcaggagatattattttctttgactggggaaataatgggacgattgaccacgttggaattgtagagagtgtcagcggtggaaccgtcaataccatagaaggcaacagtggggataaagtggcaagacggagttaccgtatcggaagcagtaatatctatggatacggtgtcccggcatattaaaaggcaggagaaaaagtgtgatagtctaatggtgaatctggagtatacaattcctgaaaatagacttgacttttaaatattacaagcgtaagatttaagaaacaaaaaaattagaagaaaggaatatctatgaaaaatagacgaaaaaagcaaaatatccaaaaatcttacgcttgtaagatttttgggctgatagtagctataacagtaattgccgtttcaggaggtgttttattaaaaaggacgataacggaatcaccagaagacacacttgtggaatatatgaaccatattgaaaaaaaggaatatgaagtaatgtatactatgatagattcagatgaaaaagtttatctgacaaaagaagaatacatacaacgaaattctaagatatacgaaggaatagaggtcagtgacattaaaatcagtcatatagctgtgaaagagaaaaaagcagatacagttacgctttcgtatgaaacatcatgtaatacaattgccggaacaatacaatttgacaatatggcggaactgaagaagacgaaacagggatataaattagtatggcaggatagcctgatttttccagatttagagagtgatgataaaataagtgttactacatcaaaagcggagagaggagaaatattagaccgagatggtaaaatgcttgcaggaaaaggagtagcaacatcagttggcattataccgggaaagctggaagacaggaatgtatctattgaaaaaatagcggagttattagagatagatgtagaaacaataaataacaaactcacagcaaagtgggtaaaagaagattcttttgtaccaattgaaactattccgaaagtagaagaaatagatttaatgaaaatacagccagaagaaaagacacttgaggagcaggattgtcagaataaacttttggaaattccaggggttatgctatcagatgtggaagttagaacctatgagttaggggaagcagcagctcatttaattggttatgtacagtctgtaacagcagaagatttggaaaatcatccaggggaaggatattcagctgaaagtgtaatcggaagatctggggtggaaaagttatacgaaaagcaattaaaaggaaaagatggttgtgatataaagattttggatagtgatggggaagtaaaagaggttcttgcaagtatctttaaagaagatggtatggacataagattaacgatagattccgatttgcaaaaatcattatacgagcagtttaaagaagatccggggtgttctgtcgcaatgaatccttatacgggagaagtattggctttggtaagtaccccatcttatgataataatgaatttatacggggcttatcatcagagaaatggacatcattaaacgaagatgaaaagaaaccattatataatcgtttccgtcaagtatggtgtcctggctcaacatttaaaccagttgtggcaggaattgggttgaaaacgggaagcatagatccaaaagaagattttggaaatgaaggtttggcatggcagaaagattcgtcttggggatcttatcaagtgacaacacttcatgaatatgaaccggttattatgaaaaatgcaattatctattctgataatatttattttgcaaaggcagctcttaaaattggtagtgagaatttcatgaatactttaaatgaaataggatttaatcagaatatgccgtttgagattgcgatgcaggaatcaacatattccaatacagataaaatagaaacagaaatacaactggcagatagtggttatgggcaagggcagattcttgtaaatccattacatctggcaagtatttatacttcatttttaaatgaagggaatatgataaaaccgtatttgaaatacaaagaagaagcatttggtgaaacatggatagaaaatgcgtttagcaaagaaaatgtagaagaaattatgcaaggggtggaaggtgttgtaaatgatccggaaggaaccggatatgctgcacatcgtgacgatattttgctggctggaaaaacagggacagccgagttgaaggcaacgaaagaagatacttctggcaaagaaatcgggtggttttcggtgtttacggcagataaaagcgtggacaaaccaattcttcttatcagtatggttgagaatgtgaaaggaatcggtggaagtggttatgttgttaaaaaagatgcaacagtattggatgagtattttgaagaataaaaaaatttttatgggaaattattacatatgtaagatatttgcgatgatattgatagttcttattgtttttacagggtgcggacaaaatcgaattacggaaaaagaagaaaagaaagaaaccgtagaatctgaaatgaatgcagaagtaaaaaaacagcgcaaacttttcggtctgtttatatgaaggagaagtcggagttaaatacattaaaggtgaaaagaaaaattatcaattgtctggaagaaaaaggatatgcggcagtagattgtgataatcagattgatatggtcaatcgtgaaaaagtggaagatttttgcaaaacagcggagaaagaagaacaggcagcagtagatattgtacaaccgaacagagattcgctacaatattaatttatgtataattatgttgtaggtacaaaaatagtgtgacagcgaggtagagaaaatggaagagcagataaaaaagatttatgaaaagcagaaaaatggacgcatcaggatgatacggaatgtgctgttgatttatgcagcattgatttgtgtggtgagtattttcaaaggaaatccgttcccgcatcaggagacagtactctttttcgatgtgaagcagccgggctgggtcacgacagatccctggcttctgtggatttgcgtggtggttgatctgattgcaggtatattcattttaatcagggacattctcagagatttttcaaaaattgaccggattctgtcacagcaatgtgatgcagaaaaatattcagaaatgctggaagagttggtaaagtacggaaagagcttggattatcatggatttcaaaaaagtgtcatgctgatagctgagtctaaatatgtagttgcactgatcataaatgggcagttgcagaaggcagaagagtatataaagaatgaatgggaaggaaaaagagagggacgttcctggcagcaggtcatgacgaatctcgaactgtcgaagaaatatcaggagaaagatgcggcaggttattcggctacattagaaaaagcagggaaagtatttcaaaagaatccactgtttatggcaaaaaatttgatgctgaaaggtgaagatgaggcagcagtaagattactggaaaatgatacggaaaagctgccttattatgaggttacacgcagattcctgctgggagtatgttactaccgaatcggaaaagaagagcagggaaaagaatgtatggaatatgtaattgggcatggaaatacgttgaagtgcaaagaagaagcggaaaaatatgtaacagtgtaagtaaggatgttctttaaaatgacagggtaacaaaaatggagaagatatagaggatggtaataaaataggatatatcgcacataaagatggtgaatctggagtatacaattcctgaaaatagacttggtttttaaatattacaagtgtaagatttaaggaacaaaaaaattagaagaaaggaatcagtggaagtggttatgttgttaaaaaagatgcaacagtattggatgagtattttgaaggataaaaaaatttttatggggaattattacatatgtaagatatttgcgatgatattgatagttcttattgtttttacagggtgcggacaaaatcgaattacggaaaaagaagaaaagaaagaaaccgtagaatctgaaatgaatgcagaagtaaaaaaaacagcacaaacttttcggtttgtttatatgaaggagaagtcggagttaaatacattaaaggtgaaaagaaaaattatcaattgtctggaagaaaaaggatatgcggcagtagattgtgataatcagattgatatggtcaatcgtgaaaaagtagaagatttttgcaaagcagcagagaaagaagaacaggcagcagtagatattgttgttgtatttgatgaaggggaaattatacaatatcatttagagtcaatgaatggaaagataaatgttcgattatgtcaggttaaatggaaggataatagcccacaggctaattattatgatgaatatgaagcatatgagtggaaatatacagaaaaaggatacttgtttctggaggaatatcacccaccgggatttgatggagcaccgggtgaaactggattcagagtgcagccattagataaaacatgccgagaattgaatcgaaaatatgttatgccgttggggtatgcacttaataatctgttgattacaaattgggataaccagaattatacggaacttgatttttatgatctttatgaaaaaatgtattatatgaaatatggaaagcaagttccatatgaagcaaattatggtggagcagaatatgaagttccaaaagatgagtttgaagaggttataaagacctatttaccatttagtaatagcgagattgaaaaaggaactttttataactctgataatagaacttttagatacagaccgcgagggttatatgattgtgaattcccatatgagccatatccggaagttatctcatatgaaaaattacaagatggaacattaaaacttacgatagaagcagtatgggaaatcagaatgttagatcaggcaatcaccagtgaattgatgataaaacctatggaagacggaagtttccagtatttatcaaataaggtaatcaagtcagatcaaaatgcaaatgcagggtggtatatgccaaggttaacagaagaagagtgggaagagaattacagtaataattagggggcaatatgaaaagaaaaagtattttgttagtactttgtataggaatgattctgacttcctgtgaaagtaagatatcgttaaacagcacagatgtaaaaaatgagaagaatcagaaaaacactaccatggaaaatccggataagggatataatctaccaatcgatgaagacaagaaaaaggaagctgtgaacgattgtgaagaaattatgggcattatccgagatatttattctgaatataatggaatacaagaagcagatcagaacactgctgagcaaatgatgaatcggatgaaagaaattatcaaacaaaatgggaatccggtcattggttccgatcattattctgttatggataattatcagaagatggaacaatttttaaaatctgcagaacaagaagaaaaaggaagtgtaattttatatgaagcagatacagatggtggaattaccagaaaagaatatagttatgatggaaaagaaatgagtgtgatgtccgcaaaaatgatctggagtgaggatacagagcctgtacttacatacatatcgctatcaaaaataaaagaatgggcatatactgaaaatgggaatttctgttatgaattatgcgtacctgaaccaccggaagtgacagagattgtagatggaagttgtattatccgggtaaagcctttgagtgaggagtgtcgggaatattcaaaaaaatatgtgagtacgttcggctatcagggaaacaatctgttatgttcaaactggaatgcggaggatatgcaggggttggattataatggactttatgaatatttttatcaaatgaaatatggagaaaaatttacggcagaaaaagaggttgtgggaattccagcagaagagttcgaaaatgtaattatgacatatcttcctgttacaaaagaagaattgaaagaatgggcggtctacgatgaacaaagtaatatgtttatctgggaacgattgggatgtggtaattattcaccaacacattttggcttgtctttaccggaagtaacagaagtcaggcataatgaagatggaaccattgttttgacaattcatgcagtatgtgattctgttgtatgtaatgatgctgttattacacacgaacttacgatgaaaattcaggatgatggaacgattcagtatgttggaaacaggattttagataatggtattgataatataccgaggtatcagtaccggttaggtaatttgcagaattgatcagtagagaagaatgaaataaagagaactgataacaggaaattatgctatcagttctctttatttatttccaaataccaagattagaaagtacagattctgttatttcggtagcctgacttccagttgcaccagaagaggattgaatatttgttgcgaagtagtaagtattattcgctgtttcaatgtatccgataaaccagccattgacatctttaccattgacacgcccagttcctgttttcccgtaaagagaaccggaagaagtagtggaaagcagcagggctttttttactgcctggatatttttactgtcaaaatgaaaattattttgatagaaatcctgtaacaattccacctgttctatgggtgatatcttcagagagaaatctgtccaatagagatttagatttgttccagtattttgattcccatagtttattgtctgtaaaaatgttcttacggcttcaaaacctgcctgtgaatcaattgcctgaaaataccagtttacagaattatgtatagccgaggttaaatcttgatcggcttcccatgaattaaaaggatatggttctccattccatgtgaaagtggaatgttctggtgtaataattccagattccaagccaagtaatgcatcatatattttataagtcgaattcggtgatacacgtgtggaagcatgatccatattataaatattccatttatcagcagactgattatataaaacaaaacttccggtgtagtccccaaaattggaagaaagatttagctgagtaatattcttttcggttgtgtcaaaatgatagccagtctgatcagaagcataaacagaaagtatgggaatgcatccaatgatgatagtagagacgaatatgcatataagatatccacgaattttttgtttaaaagtaggttggtggaatgatgcaatatttaaaatgcgtccttttaactgttttatatttccactgattcccatagtaagagggaatggagacagagctattgtttcggcaaagttaatcagtgtatttccatatgacttgtattctgtttctttcaataattgtaatacagcactgtcgcaggcaagttcgcgttcctgccgtattctttttagaaaataccagattaggggattgaaccagtagaaaacatgtactgtatttatcaaatatccaattagaatatctttatgcttgtagtgctgcagttcatgaagaagcatatatcgaatatcagttgagcttatagttccagcgttaaaatctgaaatcaagtgaattggaagataaatgcgaggatgcaggaaaccagccaaaacaggagatttcaaaaatgctgtactataaatcggaatggtatgcttgctgttcacttcgtttaaacattctatataaagagcgtttagttcttcattttgaagaggtaaagcagaactatgtaaggcgtttacttgtcttactgagcggtagagaagaaaaaacattatgaatataccgatactccagaaaaatacaagtaatgtgtgaataaaagttggtatttgggtgctgacagagacagcaaaatcatttattttatccaaattataaccattaccagaaagaaaagtggtttgaatgtcaccattggtacttgaactggctgtcagcaaatggctccacgatatagaagatggggcagagcttattggtaaaaagggaacaattagaacggcaagaaatataatcgaaagattatattgcatacgtgcggataattgcctttgcaataaattttttaatcccagtaaactacctaaaaaaatacaaatgatggcattacacagtaaaaatcgaaaactaaaatatatcaaaatatgctcctcctcccatggttaatgattggaaagaagattccgtaagctggcaatgtcttcttcagacaatttatcatcctcaatgtaagaggcaagcatagaagtgatattaccattataatatcgttttaaaaaagaattactttcctgccgaatatattcgtcttctttgaccaatggagtatagacaaaaacccggctttgtttttcgtaggttagtgcttttttagaaacgagacgtttaatcaatgtctgaattgttttaggactccaacgggaaatttgtgttaatttttcagtaatttcattggtgctgattggtgcatatttccaaacgattttcataacttcaaattcggcttctgaaatttgaggcagattgctcatgtgatattcctccaaatcttacaaatgtaataaaaatattatatatcttaaaaggttattctgtcaacgaaataaaaacttgactttaaatcttacagatgtaataatagataaaaattacacttgtaagatttggaatatgaaaggtttttataaaatgggaagggtagttgttgtaacatttgatgaaaatgaggaagaaaaattaaatgaattattacattttctgtctgctaaaaaatactctgagatgcctggtaaacaaaatagggtacttgattacggagcattaaaaataaatgcggaatatcgttctgtagaaagtaatggtgagctggttcaattgacgaattatgaatttgaaatattatatttgctggcaaaaaatccaggacggatattttcaaaggaacaaatatatacacaggtgtggaaagaaccatattatggggcagaagataatgttatgggcataattcggagaatcagaaaaaagattgagccagattctgcaaaaccaagatacattttaaatgtatggggtatgggatataaatttaatggtgaattgatgaaatgatgaaatataaaattgggcataataagtaaagataccaaaaaaagcaggagaaatttttatggaaaatgatatttggaatgaaatatcctcttttttgaaccagttgcgttgtgagaatataaacagagaaagttatatctatttccaagaacttgcaaatattcagttgaagaagaaaatggaaaaagaaaaggtgaataaacttctcgatcatataagttatgaggacagggagaagttgaagcaatatggagaaattttggaagaagaagcgtttgtgtcagaacaaagggcatattgtcaaggatatgtagattgtattcagttattggctggtttaggactcttgaaaaaatcgacggatatggaaaaaataattagcgagatgaaaagcaattaagtgtgtcgtggagggaaatgtagtatttgatagataataggatgttcgtaaagaagaaacagttatgttatatcaagttgtaatgatatagcataactgtttttaacatatggtaatagtatttattccactaattttaaatatcggtaattatcagctatttatcggtattttacaagttttattttgtatcattagtagtgtctacgttagaaataaaaggattagaatctagcagagctgtcgtagttgcaagaattacctgtaactgataatcattgcactgatttaagagccgaagaatctgatcatatgtagaattatttttattctgatttggataaacgtagtcatcagcagaaatatttaaagtctgcatggttttacaaaataattccagactgggaccgcctttatggcgttcgaggtctccaagataagccgccgatattccgagtttttcagcaagagcttcttgtgttaaatgcatttccatacgcccttgttttactaaagtggcaaataatgtttttggaatatccatgtttgtatacctccataaacttagtgtattaccctaaatttgaaaagtgaaaagggtgtaacattagaaaaaacacagggtattacccgatgaatgagaaagcatacaaatctctttcggttaaaaaaaacagattccgaaagagcagtatttgtatgcttattttcttttccggaatctaaccggagaaaatatggttcttagcaagagttcagctaaaaaattctgttcaacagaaggtattcaattaaaaaaatctcaacaatttcattagtaaatgttggaattgaaactagggtaagagccaataatgaatccagggtaataaaatatcgaattaaatgcgtccataggagtgaaatctgtcagggcgttttttgttacctaaatattgagaatgagcaattcaaaataaggtcgattgttcgtattcgtgccccgcctactgatctgaattcaaaaaaattcagattggaggaaaggtcatggaaggcagacagcctaaaagaagaaaagataaatataacccatatgaaatctatgagaaggacggaaaatattatgtttcatttcgtaatggtgaaaaagagtacaaggatttggaaataggaaagaatgtatatgaagcttttaatacgtttgaattgcaggatgtgtcgcatatgaatgttgtggacaggcatttggaacagtcagaaatctgggattccagtttatatgaacgggtatttcagaaagaggaaggtgtagaggatactgttctgaataaactggaagcggaacgtttacatagtgcaattcagcagttgtcggaaattcagagaagacgattgatgaagtattattttgaagataagaattatgagcagattgcacaggaagaaggctgctcttttcagatggtagcaaagtctgtaaaagcagcaatcagaaatttgaaaaagattttgagatagtgggttgaaaaatagcgtttaagtgaggaaacaggtggaaagagaaatattttgatccacctgtttcttcttttgtcacgaaaagactggggagcgggaagaaccttgacaaattcatatacattcatcaggcacattcctgttgttatcgtgatgagcgtaagccacattaacaaatacgccataacacaggctgggtaaagacagcgaaatcccacccgtatacttccttttggtttcagtttgtattacccggactgttgagcgaaaaatatctggttataactgtcagattgcttctggcagggcgatgacagacaacaggcataatgatactcctgtccggtcataaagtcgtgtatacaaaatatttctttgatgccgcaacaagtgagggcagcttcaggagatccctggagaggaaaactcccaatcccatatatttattttagataaaatcctgtggagctgattagcagtcagccgtctgatgatttcccaattacaagtcggggcgtcggggacaaataggcttgtattttacatatttagggataacaacagttagaaagacgagaggagatatagcaaagatggaagatagaaacgtcaggcgtggggatatttatcacgccgaccttgatcctgtatttggaagtgagcagggcggttatcgtccggtgctggtgattcagaataatataggaaatcaatacagtccgacagtgatcgtggcagcaattacaagtaaagaaaaaatgaaactgccgacacacattgcagtcccggaaatggaaggtttggaaaaggattctgtagtgctgttggagcagcttagaactttagataaaagacggttggaaaattatgtgtgtaccttagatcgtactgaaatggagaaaatcaataaagcaatccgaagaagtaccgggataccgaagataattgaaaaaccgttagtcgtgagcttgtgcagagtatgtgcaggcaatttttatgaggtgccgggacgttatatccggcgggtgaatccggagcagcgatataaggaattatgtatgttctgcaatgtccggaatgggtacgactattatataggaagaaagaacaagtaacacgtaaaagtcaagtgtgcgatttgaaaattcgcacattggacgatgtagacgaaaatggatatcttagtggtgtaccgtttttagatgttacacagctaaaaactaccggtagtaaagcgcaaagattaggacgaggaggataacgtcatggcaatgatagagaatgaaatggaaaagaaagtatataaagtagaagatgttcaaaatttgcttgggctgggacgctccaaggcatatgaatttatagaaaatgtttattatgacagaaaaccattccgggtgttgaagattggcagatcttatcgtatcccatgcaattcttttgataagtggctgaatggagacgaggagagagaaagagtgagagcagaatgaaacagaaagaaacgcagcaggagacaatgtcaaaggaaaagagagttgtcttttttgaaggaaaatcatggtatcacagaaccaaagagctgcaggacgatctgacgacaaaatatgggaaaaaaggtggctttgaaacgccggaagaagcagagaaaagttactgggaatatgaaaaaagataccagaagaagcagagaaatctccagattgcaaaaatgcaaaagacagatgtgatgcttggggattatctggaatactggtttgaaaatattttcagtccgagaattgagacaaccacgagaatggttggagcatataccttatataatctgattcttccgagtatggaagcggatatcaaattaaaatacatttcagtagagtatttagatgctctactggaacgtgtcgcaaaaatctgtccttcagcgggaaataaagggcgggagcttttgagcatcgccatgaaagatgcagcaggagataagttcataagctataatccaatgcctgagacaaagccatatccgagagcaaaaccaaaggtaagggtattaagcaaagaaaaattgaaagtttttcttgaagctgcgagcaagaatccttggtatctggaaattttactgggactgttttgtgggttacgaaaaggagaaattcttggattgaaatttcaggattttgattttgaaaaacagaccgtcagaattagcagacagcttgttggaaacctgaaactgaaagaaaaagaatttacggttacggaatatgctgttattgaaaggaatccaaagactgagaacagctaccggatattgagagtgccaaaagtggtgatgcaggaagtaaaacgcagacagcagttgattgaattgcgaaaaactgatccgggcatagaatacaagaattttgattatgtatgttgtcaggaaaatggcgaaccccgatcattaacggcaatgaatcaggcacttacgaaaatctgtaacagaaatggattggcaaatatcaccgtacatggactcagacatatgtttgcgaccattttaattgagcttggagttcctttgtttaaaatatctggtctgttaggacatagttccgttcatacaacttatgaatactattgtgagattatggacgagcaggataagattattgcgtttgtaaataatacatttgtaccacaacgaattggaacggagggatagccatgcataagacctttgactttaagaaatatgtagaatataaggtctattcggtgacaacaatcaaaaagggatatggatttcgtgtgttgctgacgtttgtagacgatagtataaagacacagcaacatgcgggattcacaaccaaaagagaagctaatgcatttcgtgatgaagtaatcggacagctacataccggaacctatattgtgtatggaaaaatccgggtagaggagtttatgattttctggttggaagatattatgcgtccccgaataacagacgacacttatacaacttacaaaagtgccattaagaattacattgttccacagattggaaagatgtatatgtctacaataaatcaggggtatatcagaaaattatataatgcagttgcagagaagtatgaatcagttgcgaaaaatgtcaggacgatcatgaaaacatcattggagtatgcatttaacaaaaatgtactggcaacaaatccagcgaatggaatcaatttaccgaagaaaataaaaaagacagagtatcgtgtcctgaaaattgacgagaagaaaacattgacacttccgcaggtgcttcgattgattgaggcaagcaaggagacaccgattcatatgcaaattctgtttgcggtattgatgggactcagaagaagtgaaataaatggtctgaaatacagtgatgtcgattacattcacaggacgttgagagtagagcgtcagttgggaaagaagccaaacagtaaagcagaagactgtgcacctaagatgctgacaaagcaggaaattaaaacaaaaacacctgcgggtgtgcgtgaacttccaataccggattatgtatttgaagcaattctggaagaacggaaaacttatgagaagaaccgcagacgcagaccaaaagagttccgggactggaattatatttgttgttctacatatgggaatccaaggagtaaaggttttcatcagaaatactataaagacttgttgaaatccttggatttgcccgatattcattttcaccagttgagaaatacctatgcaactattttgctgaagaatagttttaattcaaaaggtgtttcgcatttattgggacatgccaaggaaatcatatcagtagatgtctatggagatacgcaggaaatcatagaagactgtctggatgtattggaaccatttattgaagaagttattccaaaagagcggaaagatcagtattatgattattcagaagtgattgaaatagacttaatcctggaggaatatttcaacgcagcatgataaaaaatagaatagtagtgatagaaaaaagtacaaataagaatcgaacatttgtacttttttcttgcgttaatctatatactttcaaaaatttatttgatataatagggactgttacaagaacaaacagtaaaatatgacagaaccggagcctggtatcattaggtatttccgagtgctgttttatccgcaaaaatcagttttgtgacttttattcgtaacgaggtgaaaaagacatctattcaccataaaaatgagcatttcgttacgaatctgattacgaatttttggctgatagtgatcgtactaaaagtcacaaatggaggaatttaccatgaatgagttcaaattaaaagccccatatgagccaaccggagaccagccacaggcgattgcagagcttgtaaaagggttcaaggaaggcaatcaatgccagactttactaggggttacgggttctggaaagacttttacgatggcaaacgtgatccagcaattacaaaagccgacactggtcatcgctcataataaaacacttgctgcacagctctacggagaattcaaggagatgttccccgataacgcagtagaatattttgtctcctactacgactactaccagccggaagcttatgttccgtcatccgacacttacattgccaaggactctgccatcaacgatgagatcgacaagctccgccactctgcgacagcagcgctttctgagcggaatgatgtcatcattgtggcaagtgtgtcctgcatttacggactgggttcgccgattgattacaaggagatggtgatttcacttagaccgggcatgatcaaagacagggatgaagttctgaagaagttggttgagatccagtatgaccgcaatgatatggatttcaagcgtggaacgttccgggtgcgaggagatgtggttgagattttcccggcgtattcggaaaaaattgcatacagagttgaatttttcggtgatgagatagacagaataacagagattgatacattgaccggtgaagtgttgaatgtgatcgggcatgtggcaattttcccggcatctcattatgtagtgtccaaggagaatatggagcgtgccatcagggagattgaagaagaactggagcagcagatccgttattttaaaggggaagataagcttctggaagcacagcgtatttctgagagaacgaattttgatatagaaatgatgcgagagacaggattttgttccggaattgaaaactattcgaggcatctgaccgggcagaaagcaggggagccgccatgtacattgattgactattttccggatgattttctgatcatgatcgacgagtcgcataagacgattccacagattggagccatgtatcacggcgatcagtcgagaaagacaacactggtggattatggattccgtctgccgtcggcaaaggataacagaccgctcagctttggggaatttgaaagtaagattgaccaggtactgtttgtatcggcgacaccgggagagtatgaggagtctcatgaactgctgcgggcagagcaggtaatccgaccgacaggtcttctggatccggaagtagaagtgcgtccgatcgaaggacagattgatgatctgatcagtgaggtaaataaagaaacagcgaagaagaataaggtactgatcacaacgctgacaaagcgtatggcggaagatctgaccgattatatgcgggagcttggcattcgtgtgaaatatttacattcggatattgatactctggaaaggacagagatcatccgggatatgcgtttggatgtatttgatgtactggttggaattaacctgcttcgagaaggtctggatattccggagatcacactggtagcgattctggatgcggacaaagaaggttttctgcgttcggaaacttcattgatccagaccattggccgtgcggcgagaaatgcagaggggcatgttatcatgtatgcggataacatgacggattcgatgcggatggcgattgatgagacgatgcgccgtcgtgagattcagatgaaatacaatgaagaacatggaatcacgccacagacgatcaagaagtcggtgcgtgatctgatcagtatttcaaagaaggttgcagcagaagagatgaagctggaaaaagatccggaatccatgagtgcggcagagctggagaagctgatcaagaagctggaaaagcagatgaagaaagcggcagcagagctgaatttcgaggcagcagcagagctgcgtgataagctgatcgagctgaaaaagcatttgaatgagatggagtaaagcgaagagatagaagaggaagaacagatggctgaagaaaagaaagaactgataaagatcagaggtgcgaacgagcacaatctgaagaatcttgatgtagatattccgagaaacaaactggtagtactgaccggtctcagtggttccggcaaatcatcccttgcatttgatacaatttatgcagagggacaaagacgatatatggaatctctgtcttcttacgcaaggcagttccttgggcagatggagaagccgaatgtagaaagtattgaagggctttcaccggcgatttccatcgaccagaagtctacgaaccgcaatccgagatccacagtcggaaccgtgacggagatttacgattattttcgactgctgtatgcaagaatcgggattccgcattgtccgaagtgtggaagagagatcaagaagcagacggcagatgagatgaccgatcagatcatggcacttccggaaggaacaaagatccagctgatggcaccggttgtgcgggggagaaaaggaacccatgtcaagcttctggacagagcaaagaaaagcggttatgtccgtgtaaggattgacggaaatatgtatgagctttccgaagaaatctcattggacaagaatataaaacataatattgagattgttgtagaccgtctggttgtcagaccggggattgaaaaaagacttgcagattccatagaaagtgtattaagtcttgcggaggggcttctggttgtggatgtgatcggaggggaaccgctgaatttcagccagaattttgcctgcccggactgcggaatcagtattgatgagatcgagccgagaagcttttcgtttaacaatccatttggtgcctgcccggtatgtttcggactcggatataaaatggagtttgatgaagatctgatgattccggacaaatcactcagcatcaatgaaggagcaatcgtggtgacaggatggcagtcctgtaccgataagagcagttttactcacgcgattctggaagcactctgcaaggaatatcattttgacctggatacgccgtttgaacagtatccgaaagaaatccaggatgttttacttcgtgggactaatggaaaagaagtcaaggtctattataaaggacaacgcggggaagggatctatgacgttgcatttgatgggctgatccggaatgtggagcgaagataccgtgaaacgggatcggagactatgaaagcagaatatgagagttttatgcagatcacaccttgccgagaatgtggcggacagcgactgaaaaagggtgcacttgcggtaacggtcggagataaaaatatttcagacgtaacagcaatgtcgattgaacggcttcagcggtttatcagcagtctggaactgtcaaagacgcagcagatgatcggcggacagatattaaaagagatcaaagcgcgcctgcagttccttctggatgtgggtctggaatatctgacacttgcccgtgcaacaggaactctttccggtggagaagcacagagaatccggcttgcgacacagatcggttccggtcttgtgggtgtggcttatattctggatgagccaagtatcgggctgcaccagagagataatgacaaacttctcgcaacactcaagcatctccgtgatcttggaaatacactgatcgtggttgagcatgatgaagataccatgtttgcggcagaccaggtaatcgatatcggaccgggagccggagaacacggtggagaactggttgcccagggaacggcacaggagatcatgaaagtagaacggtcgatcacaggtgcatatttaagcggaaagatcaagatcccggttccggaaacccgcgcagttccgaccggctggatcaaagttgtaggtgcagcagagaacaacctgaaaaatattgacgtgaagttcccacttggcgtgatgacctgtgtaaccggcgtatcaggttccggtaagagttcattggtgaatgaaatcctatacaagagtatggcgaaaaagctaaaccgtgcccgtgtgattcctggaaagcataagcggattgaaggactggaaatgttggacaaagtgatcgacattgaccagtctccaatcggaaggacgccaagatccaatccggcgacatataccggagtattcgacttgatccgggatctgtttgcggcaaccgcggatgcgaaggcgaaaggctataaaaaaggaagattcagctttaacgtcaagggcggacgctgtgaagcgtgtagcggagatggaatcatcaagattgagatgcatttccttccggatgtatatgtgccgtgtgaggtatgcggcggaaagcgctacaaccgtgagacactggaggtaaaatataaaggaaaaagcatttatgatgttctgaatatgacggtagaagaggcgcttcatttctttgaaaatgtaccgagtatccgtagaaaaatggagacactttacgatgtaggactttcttatattcgtcttggacagccgtctacaaccctttccggcggtgaagcacagcggatcaagcttgcaactgaactgagccggagaagcactgggaagacagtgtacattctggacgaaccgacaaccggacttcattttgcagatgtgcacaagttgacggaaatcctgcgcagactcgcggcagatggcaatacggttatcgtgatcgaacataacctggatgtgatcaagacagcagattatattatcgatatcggaccggaaggcggtgacaaggggggcacagttgttgcgtgcggtacaccggaagaagtgacagaaaacccgaattcatatacaggaaaatacatcaaaatgatgctggacagaaaatgatacagaaatcttaaaaaatcctgaacttgaaaaaaagacttcctatttactagagatttgattataataaggtgagtatgtgaaaggggaatcgtgatgtcaatagatttaggaattgatttaggaacagcaagtatcctcgtttatgtgaaaggaaagggagttgtactgaaagaaccttcagtcgttgcctttgacagagataccaatatgataaaagcaatcggtgaagaagcaaggctgatgcttggaaggacaccggggaacattgttgcggtaagacctctcagacagggtgttatttccgattacattgtcacagaaaaaatgatcaaatattttgttcagaaagcattgggaaagcgtacatttaagaagccgaatatcagtatctgtgtgccaagcggtgttacagaggttgaaaaaaaggcagtagaagaggctgcttttgcagccggtgcgcgggaagtacatttgattgaggaaccggttgcggcggcaatcggagccggaatagatatttcaaaaccatgcggcaacatgatcgtggatatcggtggtggtacatccgacattgcggtaatttcccttggaggaactgttgtgaatacatcattaaaagttgcaggtgatgattttgatgaagcaatcgtccgttatgtccggaaaaagcacaatctgctgatcggagacaggacagcagaagacatcaagatcaagatcggaacgacatatcctcttgtagaagatgaatcaatggaagtaaggggacgaaatctggtaacaggattgccaaagacggttacggtaacggcttctgagaccgaagaagcactgcatgagactacaagtcagatcgtcgaagcagtcattggggttctggagagaacaccgccggaactttccgcggatattctggatcgtggaattgtactgacaggtggaggtgcgctgcttcgcgggctggaagaactgatcgaagaaaagacaggcatcaatacgatgacagcggaagacccgatgaaggttgttgcaatcggtaccggtcagtatgtggagtttatgaacggaaaaaaagatttctagtgataagcacatgagaaggctgtttctgtagagagacagcctttttaaaaaggaaaaagtatggaaacagtaaaaggttacgtagaacacattgtatttcgcaatgaagacaatggatataccgtatttaatttgaataatgatgatggcgatctgacctgtgtcggaaactttaactatttatcagagggagagttggttgaggtgaacggagaatatgtggttcacagtgtatatggaacacagctccgagtgctcaattatgagatcaaagcaccggaagatctgctttcgattgaacgctatctgggatcaggggcgatcaaaggggttggtgcatctcttgccggcaggattgtgaaaaaattcagggaagacaccttccggatcatcgaagaagaaccagaaagacttgcggaggtgcgtgggatcagcgaacgtatggcaagagagatcgctgtacaggtagaagagaaaaaagatatgcggaaggcaatgatctatcttcagaaatttgggatttcgacgacacttgcagcaaagatttatcagttttacggtccgaagacctatcaggtactggaaggaaatccataccagcttgcagatcagattcaggggatcggatttaagatcgctgatgaaatcgcaacgaagatcggcattcattcagactcggatttccgtatccggagtggtattttttataccttacagcagagtgttgccgaagggcatgtctatctgacaaaggacgtgttgcttcgtcgggcatctgcacttctggaagtggagattaaggatattgagaaatacctgatggatctgtcgatggaaaagaagatcgtactcaaagaatctgaagaaggtctgcgggtatacgtgtcccacttctattatctggaactcaataccgcgaaaatgctgcatgatctgaatctggaatatgaagaagccaatgtagtgatcgaaaaaaagatccatcagattgaaaaagaagccgaaatgcagcttgatgagaagcaggaaaatgcggtcatggcggctgtacggaatggaattatgattctcacaggaggtcctggaaccggaaaaacgacgacgatcaatgccatgatcgaatattttcacagtgagaatatggaaattatgctggcagcaccaaccgggcgtgccgcaaaaagaatgacagaggcaaccggatgggaagcgcagacaatccaccggcttctggaggtgaacggtaatccggaggaggatgagaacccgaaccggaacggatttgcaagaaatgcagacaatccactggaaaccgatgtgatcatcatcgatgagatgtctatggtagacctgcctctgatgaatgcacttcttaccgcaattgtaccggggacaaggctgatcctggtaggggactgtaaccagcttccatcagtaggcccgggaagtattttgaaggatctcatcgcatcggaatgttttccggttgtcatgctgacccggattttccgacaggcacaggagagtgatattgtggtaaatgcacataagatcaaccggggagaaccggtccttttggataataaaagccgggatttcttcttcttgaaaagacaggatccgaatgtgatcatcagtgttctgctgacactgatccagaagaagcttcccaaatatgtcaatgcaaaaccatatgatatccaggtactcacaccgatgcggaaaggactgctgggagtggaaaggctgaacagtattttgcaggagtatttgaatccaccggagccgggaaaagcggaaaaagaatatggcgatcacaaattccgcgtgggcgacaaggtgatgcagatcaagaataactatcagcttgaatgggagatcacaaccaagtatggactgacggtggataaagggatggggatttttaatggcgatatgggaattgtcaccgagatcaatacatatactgaaacactggaagttgaatacgatgaaaagagaaaagtaaagtatccgtttgaattgctggaagaactggagcttgcctatgcgatcaccattcacaagtcgcagggaagcgaatatccggcggttgtcatccctcttctgagcgggccgagacagctgtttcacaggaatcttctttacacggcaatcacaagagccagaaaatgtgtgacaattgtcggaaatgaccagaccttccaggagatgatccggaataccaatgaacacaaccggaataccagtctggcagaacggatccgggagttctgcggatagttacacagaaaatgtagaaaatcaaatccgaaaagcggatggaaaacttaaaaaaggtcaaagaaacaattctggaactaatttatccctcaaaatgtccgttttgtggagaaattgtaagtgcaggaaagaaacattctacggaacacaatggaatctgcaaggcgtgccgtgaaaaacttccttatattggtgaagtaagatgcatgtgctgtggaaagcctttgacagatccggcagaagaatattgctatgactgtaccaggcagaagcatctttttgttgatggcagaagtctctgggtgcataaagatgcagtggaaaatgcagtttatgcaatgaaatatcagaaccggaggatttacggacaaacgttcggaaaagaaatggcagagcattttctttcttatctatgggaaagaaagatcaccttgatcgtgccggttccgctgcattcccggcgaaaaagaaagcggggatttaatcaggcagaaattgtagcaaaggtattatcagaaaataccggaattgccatggatgcaggtgctgttaagagaattaaggcgaccagtcctcagaaagagctgggcgataaagggagaaaacgaaatatcaggggagcatttgcagtgcagaaaaatgtaaaaggagaaaatatcgttttgatcgacgacatttatacgacaggaagtaccttagacgaggcggcgagagtgctgaaaaaggcaggagccgaaaatgtatactttttgacggtaagtattggacaaggaatctgatatttgttatactgaaagtaatgcatatacgaataaaacgtatgaggtgacaaaatgttaaatgaaagcaaagttaagctgatgacaaggatggcgatgtacgaaagcaaacagggagaggaagattttaagatcagttcttattataagaaagattaccggagctttcacaccattgctacgatcatatgggtcacggtcggttatgctgttgcagtgggaatcggagttattgcttttctggatgaactgatgaaaaatctaaatatgcagtttcttgtgatgcttgcggcagctgtgataattggatatctggtacttgttattttttatggaatcgttgcttcccatttttacggaaccaaacatgaaaaagcaagaaagcgtgtgaaacaattcaatcacgatcttacaagactgaacagaatgtatgaaagggagaaacgataatgaatgatctgatagtatggagagataaattacaggaattatacgcgatgaaatcaatctatattgataaagctgtgcagtttgttctggcactggttacatttcttatgatcaaccagaatattggactgatgaaagcggtggcgacaccggttgtagcggtggcactggcagtaatctgcacctttcttccaccggttgtaacggcgtatgtggcggcaggacttgtaattgtgcatctgttcaaactgtctataggagtggcagcggcagcggcactgatctttgtggtaatgtttatcttttactgcagatttactccgaaaaaggcacttcttctgctggtcacaccggtagcatttatgcttcatgttccgtatgtggtgccggttgcctgtgcgcttgtacttggaccgatttcagcagtaccggttggatttggaacgatcatttactatatgatcgaatgtgtgagaacttcggcaacagcgatcaccagtgcggatggaattaccaggcagatttcgctgtttgtgaagacggtattccaggataagactctgtggatcactgtgatcgcatttattatctctatttttgtggtgtatacagtgcgccggctttcggtagatcatgcgtggaaaatcgcagcagcatccggtgcggttgtgaatattgttgtaattgtgatcggagatattgtattcgatatacatacctcttataatatgctgatcgttggaaatattgcagcagtcgtgattggttttatcatggaatttttcctgttctcggtggattattccagaacagaacgtctccagtttgaggatgatgaatattactattatgtaaaagccatccctaagatttcggtgacagctccggagaagacggtcaaacatatcaatgagcggaaagaaacaggtgagattgtggaaacagagccggagagaagacagaggtcgaagagtgggcagacggaaaaaccggcagtacgcaaaacaaaaacggcttctaaggtaaaatggccaaagagtccggcagttcagcgaccgacaagagttgggggcaatacagatgaaatccttcttgcacagagcctgaaggaagaactggatattcagagcattgtggaaaatgaactgaatagcgataataaatagggaaatattataaaaacaggggtataaataacggatagaaaaagggggtacactgttgaacacagtattaacacaggttttaaaagaatttgtatcagaatcgtggtacttcccgcaggtccgggtagtagatgctgttgagatactgattattacatttttattctatcagattattctctggataaagaatacaaaagcctggatgctgctgagggggattctggttgttgcattgtttattctggtggctgcaatttttaaaatgtatacgattttgtggattgcacagaattcacttccggtcatggcaaccgcagtcgtgatcattttccagcctgagctcagaagagcattggaaaaactgggggaaaaacaatttgttcccaatatggtagcactggataaaagaggaaaagataatgtacgtttcagccagaaaacgatcgatggaatcgtagaagcatcctttgcgatgggagcagtgaagacaggagcacttatcgtcgtagagcaggcaatcatgctgacagaatacgagagtaccggaatcgcactggactgtattgtatcaccgcaggtattgatcaatatttttgaacacaacacaccacttcatgatggcgcgatcatcgtccgtggagacaggatcgtatcagcgacctgctatcttccactgtcagacaatatgggaatcagtaaggagctggggaccagacatcgtgcagcagtcggaatgagtgaggtgagtgatgctctgatcgtcaccgtatcagaagagaccgggtatgtatctgtagcgatgggaggacagcttgtgcgcaatgttacaccggaatatctgaaaaaacgtctggaatctatcagtaagaagagtgtggagatcggacgtttgaaaaaaatatggaaaggatggagatcgcatgaaaagggcgttgactaaaaactggggtcttaagttgttggcatttgtattctctgtccttttatggataattgttatgaatattgaagatccggtggacgaacggacattttccggaatccaggtgacagtgacacatccggaaatcgtaacaaatccgggcaatacatatcagattctggatgacagcaggacggtatccgtaacagtaaaggcaaaacgttctattttaaataaaattaaaactgatgatatcagggcaacagcggatatgaagaatctggatgtcagaaccagatccctgatcccgatcgatatatcgatcccttcttatgcaggaaggtttgaggcaactgccaacccgatcaatctgcgagtaagcattgaacttggaaaatcagagactttcccgatcactgcaaccagttcgggaacaccgagagacggatatcaggtgggtgagctgaaagcaaatccggagaagattaagatcagcgggccagaatcagtaatcgattcaatcgacaaagtggtagcacttgtcgatgtttcaggacagtctaaagatgaggaaaaagaagcagagctgattctttatgataacaatggaaagatcatagattcgacacagattgagaataacctgggagacgaaggactgaaggtaaaaatcaccatgcttcagacaaagagtattccggtagaatttgatacttcactgatcggtactgcgagcggatatcatttcagcggaatcagtatccagccggaaagtattcagatcgtaggcacagaggagcaactggaaacggtggattctattgaaattccggcagaagagctggcagaagatggtctggaccagacaatagagaagacagtagatatcgccaattatcttccgtactgggcaaagacagaccaggatagcgcaggaggcgtaccgatcgttataaagatccaggtagagaaattcggaactaagacagtcgaattcccatacaattccattgcgctgctgaatgcaccaaaggattacaaggtgtcatatgcagaacagggcaatctggaaattgttgtgcgtggttctaaagaggatctggatgattttactcttgaaaaaggaaacgtgtcaatcaatctgaacgattgcaagacagcgggaacctataatgttccgatccaggttacacttcctgacggaattgaacttgaagatacgatcaatgtacagatcacattgacaaagagcagtggaggagaaaatgatcagtaaaaaggtaacgatcaaaaatccgacgggattgcatttgagaccggcaggacttttctgcaagatggcactggaatatgaaagtaagatcacttttcattaccgggatacggaaggaaacgcgaaaagtgttctgagcgtacttggtgcatgcattaagtccggagatacgattgagatcgtgtgtgagggaaaagatgaagagaaggcacttgaagcgatggtagaactggtggagagtgggattggagaatagtaggaaaagcgaatcaggaggtatagaaaagatgagcaaagctacattagttgttatggcagcaggaattggaagccgtttcggaggaggaatcaagcagctggagccggtaggaccaaatggtgaaattatcatggattattcgatctatgatgcaatggaagccggatttgataaagtggtatttgttattcgaaaagatctggaaaaggattttcgtgaaattatcggaaaccggattgaaaagaaagttgaagttgcatatgcattccaggaagttgatgatattccggaagcatttaaagaaaaatttgcagaaagaacgaaaccatggggaaccggtcaggcaattctctgctgtaaggatgtggtaaaagaaccattcctggtaatcaatgcggatgattattatggaaaagaagcttatgtggaagcattcaaagaactgacgacaccggaaaagcaggcagataaaatgcagatcagcatggttggattcgtactgaagaacacattaagtgaaaatggcggagtaacccgtggagtgtgcaaggttgatgcgaatcagatgcttacagaaatcgtggagacatccaatatcatcaagacacaggcaggtgcagcagttgcaacagatggaaaagagacaccgatcgatgcagacacgccggtttccatgaatatgtggggactcacaccagaattctttgagatcctcgaaaaaggatttgcagaatttgtggcagcacaggaagaaggcaatctgaaaggggagtatctgcttccaacgattatcggagatcttctgaaagaaggaaaagtcgaagtaaaagtgctgaaatcacatgataagtggttcggggtgacttataaagaagataaagaactggttgtgaatgaagtgaaggcgctggttgaaaagggattgtatccggagaagtaaatagtgtgaaattaagaaggcaagcaacatgggatgagactatggagcttgccttgctgattttgaagggaaatatggcataaaacaaaatgttcgttgaaaaagggtggagataaattcctgctttttaataaatatccattttcggaaaattatttcgtgtcgaaaatagacaaaaattgtgaactattgtataatagataagattaagaaaggaggtgtgagatgagaaaagtattggtatttgtaatggcattgagtctaagtgttatgctcttgggatgcagtggtacagatacttcaaaagaagcaaaagatacgacgcaggataccagccaggaggacaagcaagataccagtcaggaaaaggcagaaccaacgcaggacaaaacagaacaaaaggatgagcaagtggaagaaaatgacagcaaagaagaagacggcggagaccatgaagctcaggatcagattctgaaattatattatatatccgacagtgaagaaatcgaatgcgcagagatcagaacgaatctgcttcagacaaccgatatctggaacggcttaataggggaaggcgttcttagcagtgaatgcaagatgaacagctgcaatgttgatcaggaacagaaaacaatcgatcttgatgtggattccggaactggttcttacatcagaggtatggggacgacaggagaagaacaaatacttatatgtattaaaaagtcttttctggaaacatacggatgtgaacgactgaagattacggaaaacggacagcctttagagaccggacataccgtgatcaaaggatacatgacagtagatgagtaagagaagaggagtatataatgaagaactggttgaaaaaatgcagtgtggcattgctggtcttttcaatgattggtacaacaatgccggtatatgcggcggatgcgccagctgcaaaaacacagacgacaacagaggaccagacagaagagcagaagcctgaagtacaggcagaagaaccacagcagcaggaacaaacttcggaagaacaacaatcagttgatgaaaatgttgaaggggaacaggatgttcaggagcaggaagcgccagagcaggaaacgacagaacaggaagcccaaccagaagaaagcagcatgaattatgcttacgtggaaagtccatatctgcagacaccggagacacagcgaattgttgtatcctggggaacagaagacgagtacatagagcagatggtacttcatgtacgaaaagatgatgatacctgggaagactggtgtatcagtagatcggaaggaaatctgtatctgtttgaaaagtattacgaagatgagtatcagagtggaacctatgaagttgtttccatcagtgtaacagaaaatggagaaactacagattatgcgcttgcagaccttaagatggaagcgaagttcggagttaatcaggaatatgatggcatcgatgagcttcagccggttgatgaagaacagaaagaagcggcagcggaagatgcagttggtatttcggtttctacattgaatgaagatggaacaatcgaagaacagaacagtatcgaggatgcacttgatgcagcacggactgatgttctcgcatcaaccccggcgatgatgtcacttgatgatgattctggaatcagtacacaggctgcaagatctggaaaaattgttgtggcgctggatccgggacatgatgacagggatgccggggcaagctattatggactgcacgaagaagcacttaccttaaagattgctaattattgtaaggaagagcttctgaaatatgccggagtagaggtgtatatgacgagaacctcttcaaagtgtccttatccgaatgcatcaccggcaggtggctgtattactgcaagagcaaatgcagcagcaaaagccggggcgaagatctttatcagtttccatttgaatgctgcatcagcagcggcaaaaggtgctgaggtcattattccgaactacaactggcaatcaaatgtaggtgcacagggaagagagcttgcaactaagattttgaatgaactttcatcaatcggattgtataaccgtggattgtactacaaaacaggaacagatccgaagtataagtatccggatggttcactggaagactggtttactgttcaggtcgcaaataaatacaacggaatcccaggaattattgtagagcatgctttccttacaaacagcggagatgtaaacaactttttaaatagcgaagctggtctgaaaaagcttggagttgcagatgcaaccggaattgcaaaatatctgggacttaccaagactggtgaaagagtaaatgttgaggaaggtacttacgtatttagcagcgcgttgaatgcgaataaggttctgtctgttcagaatgatggatttggagatcagacagccacagtgctgaatgataaaaaagatacatcaggacagagatttgaggtcagaagtgccggaaatgggtattacacgattacggcagaacattcaggaaaggttctggatgtggctggaggatcgacggcattgggaacggcactacagcagtatttttataatggaagtagtgcacagctatggtattttacaaattcagggaatggatattatacgattcattcggcgttaggtaattgcgttgatgtgtggaatggtgggacttcaaatggtaataagatagattgctatgtgtataatggcacaaattcacagaagtggaagcttacaaaaaccgagtcgaaaccattagaaaatggtacttattctattactaactctgaaacgaataaagtactgagtgtaaatggaagttcaacaggggattcggcaaatgtatgtgttataagcaatcagaatttgtcatcacaaagatttgagttgacttatgtgagcaatggatattataaaattcttgcagaacattcggcaaaatcattggatatttcatcggggagcagcgcgtcaggaacgaatttgcaacaatatagttggaatggaagtaatgcacaattatggaagtttgttaaattgtcggatggcagttattacttgcggtcaaaactgggaacagtagttggagtacaaaagtcttcaacaaatgtaaacatgcagacagcgaatcagtccagtgcgcagaagtggaaagttgctaaaacagaaaataagccattggaaaatggggaatatgtcattcaaagtgcagcaaatacatcacttacagtgactgaaaatggaggaaatattcgacttagtacatatgcagatagcttaaaacaaaaatacaaaattacatatgtaagcaatggctattataagattgttgagagcgcaaccggaaaatcattggatataagtaatggaagtagttctaatggaacaaatcttcaaacttatgcatggaatggaacagatgctcagttatggaagtttgttagtgctgggaatggaggctattatgttcgatccagattaggcacagtaattgatattgcgaatggaacgattcaaaatggaactaatatccagatgtatacgttgaactacagcaatgcacagaagtggaagtttaaatctactgcagtgaaagcagaaactattacagaaggtatttacactattcaagtagctgcaaacacaaagtatacattagatatagcaggaggttcttcagcagatggagaaaatgttcagatttatacgaagaataatactttagcacaaaattttgtgattacatcagttggaaatggatattataagatcgtatctgaaggaaccgggaaagtattagatgtatcaggaggttcttcggcatggggaacaaacgtacagcaatacagatggaatggaacagcgtctcaatgttggagattcatagatgcaggaaatggaaaatattatattcaatcaaaattgggaacagtattggatatagctaatggttcgatttatggtggaaataatgttcaaacatatatgttgaatgaaacaaatgcccagaaatggaagcttagtaagttgaattatgctgatattgcagaaggaacatatactattcaaacggcactttcgtcaaacagagtgttagatatttcaggaggatctgttgataatggcgcaaatgttcagatatatagtagtaatggtacagcagcacagaaatttgtggttaaaaaggcatctgatcatgaatatctgattacgagtgaaagatctggaaaagtattggatgtagcaggtggttactcaagtgcaggtacaaatgtgtggcaatatagtaagaacaattcaaatgctcagagatggagatttatagatgccggaaatggctattattatattgtatcgaatttaggaacggtattggatgtgagtaatggtagtactgcgaatggaacaaatgtgcagacttacacattaaataaaaccaattcacaaaaatggaaattaataagtgactcgaaaaacagtgatttatattctatcatgggtactacatctactacagcaagtcagatggcaaactactttattgctaaaggtggtaaatatccatattctgggaatagtgttgcaccaacgattaaagatttctgccagatttatattgatgaatgcaaggcagaaggtgtgaaagctgaagttgcatttgcacaggcaatgatggaaactggattcttacgatttggtggggatgtaaaaaaagagcagtataattttgctggtcttggagcaacaggaaatggagcatcaggtaacggctttgaatctattcgaattgggattcgtgcacaagtacagcatttaaaagcgtatgcatcaaaagagagcttgaagcaaaaatgcgtagatggaagatatcaatatgtaacaaagggagttgcgccatacgtagaatggcttggacagaaggaaaacccgaatggaaaaggttgggctacagcggtgaattatggttataatattgtgaatctttatctcaaaccattattgaatacaagtaaataataagttataataggattttgcatgagtaagaaacatgcaaaatcctatttttatgtgaagaataagggataaacattgtatcttgaagaaaaatttggtatgctataggttggagttaaaaaagatgtaatattttgtaacaattttatattgtacaaatggaggttgagtatgaaaaaaggatggggacttcaaaattccagaagcagaatgatcgccttgtttatcgtggacatgcttactgtagttttggattcttacttagcaattatattgcgttttaaattggataatatctgggtgccagaggagtatatgagcagtgtggaacactatatgattataaatgtgattacgacggtaattatctttttactgctgaatctgtataatcgagtgtggtcctatgccagcttatatgagatgctattgattgtgtgtgcggcaatgctttcaacagcatttcaggcgtttggatttagtttgttgtatttaccgatcccaagaagttattatttcttttactttattttacttagcattactacactgattactcgtttttcgtaccggattttgcacacgatgcagaatggaattaaaaaatcagcaaagcattcccgcaatacgattgtaatcggagctggtgaagcgggtaatatgatcattaaagagctgaaaagcagtaaatatctgaatcagaaggttgtatgtgttattgatgataacccgtctaaaaaaggaaaatatattcacggaatccggattgtcggtggaagggatatgattcaggaagcagcaaaaaaatatgatgcagaagagattatccttgcaattccgtcggctggaaataaggctacccgtgatattttaagaatttgtaatcttacagattgtaaacttaaaattttaccgggtatgtatcagctcatcaatgatgaagttggagtatcaaatctacgagaagtgtctattgaggatttgcttggaagagataccatcaatattgatatggaaagtgtcggacagtatgtaagcaataaacgagtcttggttaccggtggtggtggatcgataggtagtgagctttgccgtcagattgcagtacacaatccgaagcttctgattatatttgatatctatgagaataatgcatatgagattcagcaggaactgattcgaaaatatcccaatctgaagctggaagtattaattggatctgttcgtaatacaagccgaattgaaagtgtaatggaatattatcgcccggatgttgtgtttcatgcggcagcgcacaagcatgtgccactgatggaagatagtccgaatgaagcgattaaaaataatgtgtttggaacctataaaactgcaagagcggcggataagtatggtgtgaaaaaatttgtacttatttctactgacaaggcagtaaatcctacgaatattatgggcgcttcaaaacgtatgtgtgagatgatcgtacagacatttagtaagtattcgagaacagaatatgtaattgtacggtttggaaatgtacttggaagtaatggaagtgtaataccgctttttaagaaacagatggaagcaggtggaccagttacagttacacatccggatattattcgttattttatgacgattccagaagcagtgtccctggtattgcaggctggagcttatgctcatggtggagaaatctttgtgttggatatgggagaaccggtaaagattgccgatcttgcaaagaatctgattcggctttctggctatacgctgggtgttaatatggaaattaaatataccggtttaagaccaggggaaaagctgtatgaagagttattgacgaaagaagaaggtcttcaaaagacggcaaatgatttgatttttattgggaaaccactggagtttgacgaggtgcattttctgagtcagttaagagagcttgaaaaagcggcgatggaagaaagtccagatattaaagaaaaagttgctggaattatttcaacgtatcacattagaccggaagataagaagagagacagtgaagcgtttcgggaactggtgagtctgggacgaatcagccatgaaggaccgagcgtggaaacagatcataagactatttaatatcagtagtaatttggaggaaaaataattatgaaaatgtcattggtagtaccttgttacaatgaagaagaagcaattcctattttttatagagaagctttgaaagtaatagaacaattgaaagatgagtttgaatttgagttttgttttgtagatgatggaagtaaagatggaacattgcagtgttttaaagatttgcgggtaaaggatgaacgggttcattacgtttctttttcaagaaactttggaaaagaatctgcattatatgctggattacagctttcaacaggagattatgtcgcaacattggatgtagatctgcaggatccaccgtcattactgccggaaatgtggaaaacaatcaaagagtcagaaggtaaagaagattatgactgtgttgcaactcggagagttaacagagcaggggaaccgcctatcagatctttttttgcaagaatgttttataagatcattaataaaatgtcatcaacagaaattgtagatggggcaagagacttccgattaatgaaacgaaaaatggtggatgctattttgagagatgcggaatataaccgttttacaaaaggaatttacagttgggtaggttttcacacaaagtggattgcctttgaaaatgtagaaagaagtgctggagagacaaaatggtctttctggaaattgtttttatattcgattgaaggaattttggcatattctacagcaccactggcagttgcgtctgtgtttggaattgtattttgtggagtttcatttatatctatgttagtgattgttattagagcgttagcatttggtgatccggtggctggatggccgtcattagtaacaataatattctttttgggtggaattcagttgttatgtcttggaattatgggattgtatttgtcgaagacatatttggaaacgaaaaaaagacctatttatattgtgagagaaagtgagtaagtaataggttatctactggaatgattgaggttgttcgaaggatttgaaatcatgaaatgtagatgaccttttgtgttagagaggagagaagatattaaaatatctaataggaaattatggaaaaaagaagaatagaatgggttgattgtgcaaagggtatagcaattatattagtaataattggacatacagtaaataatggaaaatatgggagtaacttacgtggaatgattttttctttccatatgccgttgttttttatattgagttgtatgacatttaaatgctccgaaaatgtagaacaatataaagaaaaaacaattcgtgcatttaagcatttagttacgcccgcgatatgtgtttttggtttagaaattataattgagtgttcaagaaatattaatttattatttgatttaaattattggaaacaagaagcgtattgcttgttatttgcaagtggtgtagaagtagaatttaatggattcaaagtgagaggtattggaataccatggtttttcttcgcactatttattggaagaataatatttgattatcttcacttgaactttgaggaaaaacaattgggcatactttcggctattatttgcacaatagggattttttttggaaatacacaatggcttccattttcattagatatagcgttagctattatgccatttttctattgtggatataagttgaaaaaagtagatgtgaaacattgggctttgaaaaaattatttatatggagtattgtttggattagtacattatatattacttttccggattataataactggacatatttagagctcgctatgcggagatataatttgttcccaatatgttatttaacagctgtagcaggaactatgatggtaattgaatttagcgtgttaatgtgcaataagttaaataaaatagtaaagcctataatgtatgttggaaaaaattcgttatatttattatgtatacatgccatggagtacaattggtataaaatatggtatatagaaaatcatcagttttattcagcaataaaaagaacgattgtggatttgttgatttttattgtatttatgtgtgtgagaaatataattaataaaaaagtgagaaaggatgtgagtttgtgaataaaatggaaaaaacaaaaacatataaaataataggatgtaatgttatgtttacagcttttggttatattatattatgtataatatctaatgtgtatccgtttggatcaaaaagcaatatgatttgggatttgaatatacaatatgtggattattttgcatattttaaacaagttttgttaggaaatgcgcatataggttattcctttttaaaatcattgggaggaaatgcagttggaatttttgggtattatttagtatcccctttaaatttgttagttgttttttttaaaacagaagacttacaaatgtttgtttttgtaattacacttattaaattagtattaatagcagtaacatttagtatttacttaaagataagatttaaagaactcgatgcacaatatcttataataggaactatgtcatttgttctttcacaatatgtgatagggcagatgacaaatattatgtggttggatggagtatatcttttgccggttatgatgttaggcgtatataaatttgtacgtgaaaacaaaaaagggatgttttttggaacggtattggtaagtattctttttaattggtatacaggatatatgaattgtttctttattccattttattttttgctggaagagagcctaaaagaaaaggaagaaaacaagattcaattgaaaaaaataatatcaaaaggaattaggttctgtcttgtggaaattggtggcgtattagctagttctgctttatttcttccagtggtatattgcttactacaaggaaaaggacaaatggaagagaatatttttcaatttgtgacgaatggtaagtttttagaaatttttagtggctttatgattggacatacggcaaacaatgcgcacattgttttatattgtggagaatttatatttttagcagttgttttattctttttgaataagaatataaaaaaacatgaaaaagtatatgttgcgttaatgctaatatttctgatagcaggatgtttttttaaacctttagaaaatatttggaatggatttagatttgctacatcttattattatagattcagttatataactaccataatgttaatttatacagccgcgtatggattaacaagaaaagaaaaagtggaatttaataaagtagtaaagattattattggaatagttggaatttggctattagaagattcgattcagcagagtgtagatgttaagtatttgtggttgtctatttttattatggtgagctatggagtgcttttggtttgggaaactagatcaaaaatatataaatatttgagttttatattagtgatcgtggaattgattttaaatggtcgatacgttatgatgacgacatatactaatgaagctgagagttactcaaaatatgtttcaaatgaacaaaaattgatagaaaaaattaaaaaagatgattcaacatggtatagaatggatgaaacgacaaaaagagcaggaacagcaaatgtaaatgagagtatggtatatgattattatagtattgcgcactatagttctgcttatgatgttgaagtaagtcagtttcttactgatatgggatacaataataatgtggatgttactacctttgatgagccgattttaccaatagatagtttgctgggcttaaaatatttattagcagaaagagagttttgtggatatgaaaagcaggaaaaatatggagtaggtaatggaaaaagtgtttataaaaatgattatgcacttaatattgtgatacctgtatctgaaaatattattggaaaagtagaaggagagaatccttttgaaaaaataaatgatttatattcaaaaatattaggagagcgtactgaaatatttgaaccaattgatggtatgattgacactgatgaaaatggaaatgtagaaatttcaacaatgccaaataatgagaatggaatagtatatgcttatgtgaaaactgatattacagatataacattgagagttgatgaaaatactaattgtatttataatggatggttatccagaggtgtatttaatattggaaaaagtagtgaaagccataaaataaaacttgaaaaatttggagagcagttgtcaggaaatatacaatatgttagttattgcttaaaattagataagtttcaagagattgccaaagaacttcaaaaagcgtcaattagcaacgaaaatattaaagatggaaatgtaaagttaacgtataaaagtgaagagagtggaaatattatgctttctataccatatgaacatggatggagcgcgtctattaatgggaaaaaagtagacatagagaaaggagcagatacttttattgtactgcctgtggaaaagggagataatgaaataattttaaaatataaagtaccatgggtgggcattggagtgataattacgttagttactttgtctatatttggcatgagctgttggcttgaatggtgtaaaaagcgtaaaacaaatacgaaatttgacaaaaataatagcatttgatataatctttccatctaaagaaatgtgtagtataataattaagtaatcaaaataaaagttggtgattcagatagaactaaatatctgtaaaaccaactttttttgagaaaaatattatttatataagttaggagaacaatgaacgagaagatattaacagtaacgattccaagttacaatgtggaagcatatctggaagactgtctggaatcttttgtgaattccgaggtcatggatgatattgaagtattaatcgtgaacgatggttcaagtgataatactgccaagattgcacagcgatatgtagataagtacgaaaatacattccggttgatcaataaagaaaatgggggacatggttctacgattaacacaggtgttcgtgaggcaaaaggaaaatatttcaaagtagttgatggagatgactgggtagatacaagaagttttattcatcttgtgaaagtgttaaaagagagcgatgcagatattgtggcatctaattatacctggattaatcatacaaccagaatgccagagaagaggcaggaacatccgtttgaaaaaatagagtataataagctgtatcagtttgaagagattgtcggtaaaacgattattgatatgcatgcaacaactgtgaagacggaattgtttagaaaggctgatgaacagattgacgaacacactttttatgttgatgtggaatttattgcatttccgattccgtatgtgcggacagtgtattttatagaagagccggtttatcagtatcgcctgggacttccgggacagagtatgtctattcagaagatgcagaagaatctgaagaatcatttgcgtgtgcttatgcggctgaacagctattgtaagaaagcagaaaagattgctccggcagccaatctggagtatatccgtgagctgacagcaacaattcttaccagccagatgaagatttatataagttttcctcttaagaatggtatgagaaaagaagcaatgaaattggatgcatacttttatcataagaaccgggaagtctatgacagagtaaagaatccggctgttctggttttgaggaaaactcgatatgctgcgttcccgttagcggttcttgcttttaaaggacgaagaaattcatattaagatggagaagaaaaatgagtgtgacaagagataggataaatacattttttaggtataaggatttattaagagaactggtagtcagagatgtgaaattaaaatacagaagaagtttcctgggatatgtatggagcattttgaatccattgctgattatgttagtaatgacgcttgtattttcacagatgtttcagcgtggaatagaaaactttccagtttatctgcttactggacaggcactgtttgattttatgaataatgcaacccatatgtccatgtattcagtattggataatggagcactgattaagaaaatttatgtaccaaaatatatttttacattgtcgaaagtaacaagctcattgattgatcttattttttcaatgggtgcattgattttggtgatgctgattacaagaacaccattttcaccatattttttattatttccgctggtagttataccgctttatatttttgtgtgtggaatgggattcttcttgtcagcagcaaatgttttctttagagacattcagtatatttataatgcaattactgtagcatggatgtatgtgacaccgatgttttatccaattgatcttcttccggactggctgagaaaactggtagaatactgcaatccgatgtattattatatccagtttttcagagatcttgttttatacagacattttacaacaccgagaatttttgtcggttgctgggtgatggcgtttattatgctgacaattggacttggtgtatttaagaaaacacaggataacttcattttgtatatctaggagaaaagataatgagcgaagaatatattgttgatgttgaccatcttacgattcggttcaacatggcatctgaaaaggtggataatttaaaagaatatgtaattaaactgattaagcatgaattgatgtttcaggagtttttggcgttaaaagatgtaaatctgaaagtgaagaggggagaagcgtgggggttgatcggaactaatggttctggaaaatctactcttttaaaagcatgttgtggcattttaaagccgtataagggaactgttacaacgaaaggtacaattgctccattgattgagctgggtgctggatttgatatgaatatgacagcaagagaaaatgtgtttttaaatgggacagtactgggacattccagaaaattcatggaagagcattttgatgagattattgagtttgcggaactttgggatttcctggatgtaccgattaagaatttttcatcaggtatgcaggctcgacttggatttgcgattgctacgatggtaaggcctgatattctggttgttgatgaaatcttgtctgtaggagattatcagtttcaggaaaaatgttataagcgaatggaagatatgctcagtggaggaacaacacttttatatgtatcgcatgatgtcaaatctgtaagaaagctgtgcgatcatgcaatttggattgataaaggtgtggtaagaaaaagcggtctggttgaagaagtaaccaatgagtatatgaatgaatagtttgatgggagaaatatgatactacaaaaatttgctttatatccgtattcagaagagacgactcagctttatatgaaaacaactgatgatgttgtgaccgacaaggaaaaagttgagttaaagactttgacaaaagtaaatctggaaacatattttaatttattttcatgcctgaagtggaaaaaatatgttggagttgagtctgtttatcttagattaaagctgaatggaattgtaaaagtaaaaatagatcatcttcaggtgaaagatggaaatgtagaaaggcatggtgtactggacgagcaaattcagtcagatggcatggaatatgtgacttcaaatgaatttgcacttccagaagaaggaatgcttggagttacaatagaggcagtgtcagagacagtgctttatgcggctgatttctcaacagatcagactgatctggaggaaaatgacatctgtattggaatcggaatctgtacgttcaagagagaaaaatatgtagagcgtaatatgaatcttctgaaagagggaatcttgaataatccggctgcagaagcgtatgatcatattaaaatttgtatttcggacaatgcaggtacgttagaaccagagaaaatcgaaaatccagaaatccatgtcgtaaaaaataaaaatttgggtggagtaggcgggtttacccgcaccatgctggaatatttaaatggcgaagaaaaaataagtcacgttctgttaatggatgatgatgcaattatattaccggaaacaattgaaagaaattatcttttcttaaaacatttaaagaagaaatattataattatgtagttggtggagctctgatgcgattggatcatccaagtatccagtatgaaagcggagcattatggaacaatggagatatgattgcacataatcatgattttgatatgacttcattggcagaatgcattacaaatgaagtcgagattgaacatgattatgttggatggtggtattcctgcataccagtcacatttattaacaaaaataaattaccgcttccgttatttattcatcgtgatgatattgaatatggattacgtgcaaatggagaatttattttattaaatggaatttgtgtatggcatgaagcgtttgaaaataaatgtccgggaacaaatgaatattatgatattcgaaatctggcaatactgaatgcgattcatgatgaaaagtttacggctaaacaatttaaaaaggttttatttaaagagattagcagcaatataggaaagtatcgctacaagtatgtggacttaaatctactcggaacacttgatttcttaaaaggagcaaaatggttcagtgagcaggatggaatagagattcacaaaaaactggcggcatataactatgaaatgaaatcaaaagaagattttatcggttacaaaggtttgacggaagaagatcttagtccatatggaaaagaacaaagagagcatgttccatttatagaaaaaagctggaagatggctacgatgaatggacattttttaccggcaagacatggaaagccaaaagcagaaattccctatccgaatatttatgatttgtatcgatacaaagaagtgttgtatatagacagtacagatcatgtattagatgcaaaacgaagtgttattgcaatgatagcatcttatattaaattttttaaagtatgtaaacatattgaccagagatatgataaagtatgtgaacagtaccgaaatatgttcgacacatttacatcaaaggatttttggaatcattatctggaattagataaaaacatggatttataaggaggagcatatgggatcaccaaaagtaacagtagtagtaccaatttataacgtagaaaaatatcttcgccagtgtctggacagtattgtgaatcagacattaaaagatattgaaattatttgtgtagatgatggctcaacggattcatcaccgcagattatccaggaatatatggataaggattcacgtgtaaaggtaattacaaagccaaatagtggttatggaaattctatgaatcgtggatttgatatggcagagggcgaatatatcggtatcgttgagtcggatgattatgcggatccggagatgtttgagaccctttataatattgccagcaaaaatcagttggacgttgtgaagtcaggatattatttttactattcaattccaaaagaaagaaatgaaaaaattgaaattgtttctaagagtagagcaggagttacattctgtccggcaactgattttaaagctccaatggaaatggtggaattcttcaatattaaaccaacaatctggtctgcaatttatcgcaaagattttatcagaaataatgataccagatttaatgaaacaccgggagcttctttccaggatgcaagttttaacttcaaagttatggctcaggcaaaaagagttcagcttattcaggaagctttcttacattacagacaagataatgagaattcatcggttaattctccgggaaaagtattttgtgtgtgcgatgaatataaggagatgcagcgctttttagatacaaatccattaaaccgaggagaattagagtgtgtatgtaagcgtattaagtatgattcatatatgtggaatttcggacgccttgctaagaaatttaagtatatttttattgaacgtgcggcggaagaatttaaggatgactttgaaaaagggacaatgaatccaaaatattttgaaaaatataagtgggaagatgtgaaaaaattagtggaagatcctataggatattatactgaaaaagcgttgaaccagcctggatattcaacaaaagaattgcgtgagattaaggcatcgtggtcatacaaaatcggaagaatgattacattattgcctagaaagattcttgggggaattcagagcataaaagatgacggggtagtatatacttttaaacttggatgcaaaaaaatgggagcattattatggaagtaagaccaaaaatatcggtagttataccaatttataatgtagaagcttatttaagcagatgccttgaaagtgtggttaatcagacattattggatattgagattatatgtgttaatgatggaactaaggatcattcagttgatgttgttaaaaaatacaaagatatagatgatcggattcaactggtagaaaagaaaaatgggggactggcttcagcacgaaatgcagggatgaaggtcgcaacaggacagatgattctgttcttggattcagatgattatctggctttaaatgcatgtgagagattatatgaagaatatttgaatcataaggcagatatcattgtgtttggatcaacgccatttccagaaataccagaaccagatccttggattttgtggaggttagattgtagagatgtatattatccagaatttgaaccagaagcattgtttgaagaaccatgtggtcagccattcgcatggaatagggcattttctttagattatttaagaaataataagctgacatttcctgaaaatgtactttttggggaagatattgtgtttatgtttgaatgtatgccaatggcgggaagtgtccaattcatagaagataaattgcatttttatcagtatttcagacaaggatctctgatgtttcggtatggagcagatgttgataagaaaatgcttcaacatgttaaaaatatgaaagttattactgcattttggcatgaacatgggtttatagagaaatgggggaaagactttgttgaatggtatttggaattcctagtaccggatttgatagagtataaaccatcaaattgtcagtatctggctcagtctgctttaaggattatgcaaaaatatgatttgatgccttatcttaaaaaatcaaacagcaaagtaaaaaataagtatagaaagcttgtgaaaattgctaaaaaaagttaaactttgagaggaataatttcgtatgcatttattgcaagaaaggaatgaaatgggaagaatatgggaatatgtgtattggcgattaccattaggaaagagacagttctttgataaagttgtcgatataaagcaggcaattgaaaatataaagcgagcaattgaaataagcatcagagataattataattataaaaatgagctttatgggaaattagagtcattaactggtgaagtgaagatattgcaagaagaaaatgcaagattagagaaaataataacacattatcataagcaggatatgcaaatgttctggcaagaatatcgaagagaaggggaatctactgctgatgctcagaaaagatttttccttgcattgccagaagcgaagggagtaacccgaaatttgcaattgcttgaaaaggatttgttaaaagcacttattactatttgtgatgcacacgatataccatgttggttatattcgggaacgttacttggagcagtaagacataaaggctttataccatgggatgacgatttagatacttgtatggcaagagaagatatagacaaattaagggatattctaaaagataatacagaatataaattaactgttaagtatgatccgtggggatattgtaaacaaattcgattttgttataaagattcccaattaccagtattcgtagatgtttttccgtgtgattgggcatgtacagcaacaaaagaaacttgggaagcgaattataaagtaagaatggatttgaaagcggaaatgacagatgaaagcaatccattcatccgagaattcagaacagttggttgtgtagatgataattctgccatgggaaaacaggttgcgaaaatatttgatagatattataacagtttaaaagaacagaaggtattatgtgataaagaagaagcagagggatttctttttggatacgatagttggaatccatgctatgacagtaatattaatgctgtagcacaagtttttccgttaaaaagaatggaatttgaaggaattgagtgcaatgttccaaataaatatatggaaattttgtgtgaattatatggagaagacatatatacattcccatgtggagaaccacattttcttcatgctgattggaagaagaatgcgaaacttttggaaacagaagtaaagaagagaattaaataggaaaatcataatgtcccacgcttttttagtgtgggacattatgattagttaattgtttttagaatatcgatagttcgttctacaccagtttttatgtcatattttgcggaccagccaagttgttttaattttctgctgtctaatcgagcttttgtagccttactgtagccggcactttctacagaatctggtatttcaaaaatgactttttttccagaatattcagcaataatagaggctaaatcttttagtctgatatctgatgcattgtctgctacattatatgcttctccgcaggagcctttgagtagaacagtaagtaatccagaaacagtatctacaatatataaatacgaataatattgagttccggcactttttaaaataatattttctcctgatacacctttgtggagaaattgagataaggcttttgtatcagtatttaggagggttggaccatatgatcttgttaagcgaggaataaccacatctaatcctttttgcttgatgtatgcctgacataatgcttcactacagcgtttgctttctggataaccagctctcatggtattacaatctatataaccacaatagttttcgtcaaatttttcaatatcgcctctgttttcaccataaatttcatttgatgaagtaaaaacacatcgtgttgcatgatgtttgtaagcaaaatcgagcatattttgagtgccaataatattagttgttattgtcccgattggatcagtagaatattgaataggatgagtattacttgccatgtgcaaaatataatttacggtagttagatcgtctctttgcaatggtgaattgacatcatattcaataaaatgataccaattggtttgtgaacaataactaaaacgcttatctgctttagatttatttcttcccaataaatatatagtacaatttaagttgttataaatgtttttgtacattagaacatctataagaaaacttccaactaatccggtggctccagatatcataatggatttgttttttaaatcgttccaaggtaaggaaagattagcgacataacgaatgtcttcttgatataatgaattttcaaatacttgcatgtctttttctccgtttttattttagccaggtatctttatctgcttttaaataggctttaaataattcaagatcatcttttgttgttaacttgaaatttttatcagatcctgcggcaaagtgaagtgttacacctaattcaaccatcatagtattcgtgtaatgtgaaccgtaaatacctgtttctgtttcaaaggcttcgtgatatttggaatcaatcaagtcgaatttatatgcttgcggtgtggaaacacgacgaagagtttcacggggaataaattgtgttgttgttgattcatcctgttcatttattacaaagatctgttcattgtatggcatggatgatacagcgttcccgaattggttacatttgctgattacatcacttaatactgacggttcaacaagtggacgaattccatcgtgaacgatgatattatcatctgcatttgcttttccttcaagattatagacaccatttcggatagattcctgacctgtttttccaccagaaacgatccattttaatttgctgatattaaactgtttcgcatatgcccataaaatatcatgccatccatcaaggcaaacaacttcaattgcatcaatttgtggatgccgttgaaaagattccagtgtataaattagtattggtttatcgtacacatttataaactgcttaggaatatcttgtcccattctgctgcctgatccgccggcaataataactgctatattcataataatttctcccagcaagattgattataattttcggagtttatattaaaaacaatcatgcgctttctttttatatactttagtcatattttataacagactgtacaggaaaacaagagggattggtaaggatgcaggttgttgtatacaaaaaaatatagtataatagcaaaagtttggaaaagaaggaaagatgaaaggataacaaacatgaagaaagaaaaagatatatttgactgtatcatggaacttccaattttgcgaattttaaatccgttttacaaaaaaaataaggaaattttattatatctgtttttcggaggtttaacatttatagtaagtattgcatcttatgcattttttaacattcagttaggttggaatgccctgatagctaatatcggttcgtggattctggcagtattattcgcctatgttacaaacagaatctgggtatttgattccaacgctgaaactacggcagattttatcaaagagatcaccagtttcgtaggcggccgagtagcaacgctggtaattgaagaactgatcttatttattttcatcacaaatctgggaatgaacagtatgctggttaaggtagtggcacaggtgattgtgatcgtgctcaattatgtgatcagcaagctgatcgtgttcaaaaaatagcagaaaagtagttaagaaatagttttaattgtattttatggatttttttggtagtatatactatgtaataattttgtaataattgttacatagtatattttattttaaagaaagaagaatttttatggagaatatgcatatcgctttttcacctccggatatcacggaagaggagatagcagaagttgtagatacgttaagaagtggctggatcacaaccggaccaaagacaaagctttttgaaaagaaactggcagagtatagtgaaactaatagagttgtctgtctgaattccgcaacggcctgtctggagatgaccttacgacttcttggcattgggtcgggagatgaagtaatcacaacagcttatacttatactgcatcagcaagtgcggtagagcatgtaggagcgaagcttgttctggtggatgtggcgaaagattcttatgagatggattatgagaaactggcagatgcgatcacagaaaagacgaaagtaatcattccggtagatcttgccggaatcatgtgtgattatgacaagatatttgaaattgtagaagcgaagaaatcatttttccatccggcaaatgaactgcaggagaagttcggaagagtgatcgtagtggcagatgctgcgcatgcatttggtgctgaacggaaaggaaagaaatgtggacaagctgcggatttcacaagcttttccttccatgcggtaaagaatcttaccacagctgaaggtggagctgttacctggcgtccgatcgaaggtgtggatgatgaagacatttataaaaaatatatgctcttttcactgcatggacagtccaaggacgcgcttgccaagacacagcttggcgcatgggagtatgatatcgtagctccttattttaaatgcaatatgactgacattatggcttccattggactggtgcaattaaagcgctatgatgcattattagcacgacgtcgggagatcatagaaatgtatgataaagcattggaggagcttccggtaagtgtactgaatcattttgatgcagatcataagtccagcggacatctgtatctgatccgtgttcagggaaaaatgcgggaagaatgtaatgagatcattacgaagatggcagaacggggcatagcaacaaatgtgcactacaaaccgttgccgctattatctgcatacaagaatctgggatttgatatcaaagattatccaaatgcttatgcattatttgaaaatgcaattacattaccgcttcatacgaaactcacagatgaagaggtaaaatacgtgacagatgtattgaaggaatgcatcggataggaatgctgtatgagaaaatgggaagaacttccgaagtttatgagaacggacgaagtaaaacaatactatgatatcctgatcagacatgaaaaagaattaaaattaaaacgatattttgacattctgctgtcgatgattttgcttgttatcttatcaccgatcatgttggtcatcagtattgcaatcaagctggactcaccgggaccggtgatctacaagcaggtgcgtgtgacacagtatgggaaaaaatttcacattttaaagttccgtacgatggtgcagaatgcagataagatgggaactcaggttacgatcagtcaggactccagactgacacgggttgggaaagtgatccgtggctgcaggattgatgaatttccgcagcttatcaatgtccttcgtggggagatgagctttgtcggaaccagaccggaagttgtgaagtatgtaaaaggatatactaaagaaatgtatgcgacacttttgttaccggcaggaatcacttccagagccagcgtatgctacaaagatgaaggtgaaatgctggagcatgtagaagatgtggattacgcatatattcatgaagtgcttccggaaaagatgagttataatctggaagatctgcgcaaatacagtctgtggagagattttatgaccatgtttatgacggtatttgcagtattgcgataaataggagagagaaagtgctagataaagaaagtaaaaaggattattatttcatttattgtattgtattaattgtggtgtcacttccgttattaggaattgatgcatatagagggcatgatacaggatttcatattcaacgaataatttctattaagaatgcgatattggaaggacggattcctgttagaatatatacagaggcaatcaatggatatggctatggagcaccattattttatccagatatttttctttatattccggcattattgtgcgttataggaattccggtgacagtaagctataatatatttttgattttgataaatgtaattacattatatattgcggtttattcatttagcagaatttctagttcgaaaacgattggaatcatggcggctgtactatatgaatcatcaatatatagattggtggatttgtatacacgaggaagtatgggagaatatttggcattaatgttcatcccgctgatatttttaggcttgacatttgtgattcaagggaaaaaggataaatggtatattctgggactgggatttacgggtgttttgcagtcacatattttgacgtttgttataatggttgcattaactggaatagttattttgatcaatattaaaaagattttagaaaaagataaaatatttatgctaataaaagctacagttgttactattttgattaatgcatggtttttaattccgtttctttcagtgtcagatatgaatgttattgcaatgatgccagatgaaaaattttggaatacagatgcgcagcttattcaattatttgaagtttctagtctctctgtgagtggaggggaaactttttcacagggaataacaaattctattcctaaaacagtgggtataccaattattgtaggatgtatcatgatggcatatactttaattagtaaggagcgaaggaaggatattcctaacagacatcggaaagtgataattggtgctttaattacaggaagtatcggagtaattatgacaaccaaccttttcccgtggaaaattatttcaaagataggtatattaaaacagttttttgaaaagtttcagtttatgtggagatttaatatagttgctgttttatttttaagtttagctgctgcatatggttactattgtacgtttggaaaaagtataaatggaaaaagaatattaataatagtttgtgcaattgctagtatgtatagcttatgttttgtatgtaattatgcaaaaacggtaggatcattcgattccaaagaagcatatgagatgggatattctgatgatttatatttgctgcgggaaaatcgaattttcgacagagaggaattggaaagcaatgcagaaaatatagagtatacggattataaaagaggaaattcaacggtttcatttagttatgaaattaaggacacggataataaagatttttatattgatgtaccaataaccttttatccagtgtatgtagcatatgaagatggaaaacagatagaagtaacgcaaagtgatagcggagtcgtaagggttaatatcactaaaaaaacaggggcaattattgtagaatataaagaaagcatatcctaccgaatagcggaaataatttctcttataagtttaataggagtaggtggagattttatttttaaacatacgaagaagttgaaaaataaaaggagaaatgtatgttagtatcagtttgcacaattgcgcgtaatgaagaagagtatctcccacatttgctggaggatatcacaaaacaagattatccggcagaacagatcgaagttgtgatggtggacagcagttcaacagacggaaccagacagattatggaacgttttgcagaagaaaatctgcaatatcataattgtattgttacggagaattcgggaaacaatcaggcatctggctggaatcaggcaatccgcagttcaaccggggatatcattattcgtctggatgcgcatggacgtattccagaggactttgtttctaagaatgtagaatgtatgaaaagcggagaatatgttaccggcggaccaagaccgaatcttccggaaaaagacacaccatggcagagacttttgctgagtgcagaaagttccatgttcggaagtggaatcgcaggtttccggagagagaatgaaaagaaatatgtaaagtctatgttccatgcggcatatcggcgggaagtatttgaaaaagttggacttttcaatgaaaatctgggaagaacggaagacaatgagatgcattaccggatccggcaggcaggataccgcctgtgttacgatccgcagattcattcctggcagtatgtgagaagctcaattccgggaatgatgaagcagaaatacggtaatggagactgggtggctagaacacttggtgtatgtccgggatgtcttagtatttatcattttgtgccgtttgtatttgtgattgcaattgttgtaacatccattttggcagcactgaaaaagccatttctggcgattgcaatgtggattacttattggtgtggtgcaatcgggatggcaattcttgctataaaaaatgaggcgaagcatatatgtcagcttttacttcctggaatcttctttttgcttcatttaagttatggagtgggaagtgtagtcggaatgggaaagatgataaaagataaaattacaaagaaataaaagagaggatttagtattatgaagtatgattatttagtagtaggaacaggattatacggggcagtatttgctcacgaagcaaagaaaaagggaaagacctgcctggtaattgataaacgtccgcatatcggtggaaatatttactgtgaaaatattgaaggaatcaatgttcacaaatacggtgcacatattttccatacctccaataaaaaggtttgggattacatcaaccagttcgcagagttcaacaattacattaactcaccggtagcaatttacaaggatgagctttacaatctgccgttcaacatgaacacatttagcaaaatgtggaacatcaagacaccacaggaagcaaaagacatgatcgcaaaacaggttgcagagactggaatcacagaaccgaagaacctggaagaacagggattgtctctggtaggaaaagatgtatttgagaaactggtaaaaggttataccgaaaaacagtggggacgtgcctgcaaggaccttccggcattcattatcaaacgtttaccggtaagatttacatttgacaataactactttaatgacagatatcagggaatcccgatcggtggatatacgaagatcattgaaaagatgcttgatggaatcgaagtaaagacagataccgattactttgaatttatcaaagaaaatccggatatcgcagagaagacactgtttaccggaatgatcgatgaatacttcagatacaagcttggagcactggaatatcgttctgtaagattcgagactgaagtacttgatacagacaactatcagggaaatgcagttgtaaactacaccgaaagagaagttccgtacacacgtatcattgaacacaagcattttgaatttggaaagcaggaaaagactgtcatttccaaagagtattcttcagaatggaaagtaggaatggaaccgtattatccggtaaataacgaacagaacaataagctgtttgaagaatacaagaaacttgcagaccaggagaagaatgtgatctttggtggacgccttggaaattataagtattatgatatggataaggtaattgaggcggcactggagatggtggctgaggaattataagaaaaatatagtataaaaaacagggtatgaatgaggatatcctgttttttatgtaatatgtatgggaagaagttgaagatggagaaaataattgaaataagaaataaggttgaaatgaaatgggaatccatttcatatgaaaaaaagtgtgatttgtcggaaaaaatttttttgtgtgcgttaagtgtatggataatctatgcgtttaattggataacgatgtttcatatacagtggcctgaacatttatatttttatatacaggtttttgttggcatggcagtactgtttagatacatggtgttgattcctaagaatatagatagtttaattttagctcttatagttttaacagtatttgtaatttcaaaagatagaaatggaacaggattattacttgaaacaggattgtttattatcggagctagaaaaattgattataaaaagattttaaaagtatatcttgcaattgaagttccgttaacgcttattactttaatggctgcacgtttagggataattgaaaatttagtatatcatcgtggagagcatgtgaggatgacctttggatttgtatatcctacaaattttgtgtcgcatcttatgtttatgattgcagcatggattgcaataagagaggtaaaatgcacatttttagagttaggtgtgatttcaatactcgtagttttcctggataaatattgtgatgcaagatgtggagaaatatgtattatccttattgtgctttgtactgcgtatttaaaatgcagaatgtattttgctgagaaaaagggaaaaaagtataagacgtctaagcttttaaactttttatgtctatgtgtgccatttttgggtgcgggaacaatgattctgttgtcaagattttatgatccaactaaaagctggatggcaaaactggataatattacgtcaacaagacttgctttgggaaagaaaacatttgatctgtatgacataaagttatgggggcagtatattgaattacgcagtagcggtgggacaacagatcctgttccagattacttttttattgattgttcgtatttgaatatattaatgagatttggattggctgtttttgtgataacgatatttttactgtgtattatgatcattaaaagcttaaaaaacccatttttattagcgataatagttattgtatgtatacattcaatgatagaacaacatttgtttgaattacattacaatatattttttatgttagcatttgcaaattttaatatacaagataatagaaaaaagatgtttataaaaaacgtgagtaacaatgtgttagaatgaatcagggtatgggataaaacatatcctgatatttacattttgatgattttgtaatcgttgacaatattgcatttttctaatatttgtgctttactgtattatgtatgtttgtaaatcataagtaaaggaaatgaaaggaaaatgaaaaaaccaaagataaagagtatcggatatggatgctattgtattctaatgatcataatatcagtcctaggatttattctttataatctgggaaactgggtattagacacgtgggggctgttgtctatcgatgaaattttttttcatctgaaagtaccgcttgatgggacaaactcagacgtagtacttgatgggatcaatgcatgcgtaccattggcagtattagtattatttttatctattttcctgattataggattaaggaataagcatggaaaatgtatgattgcgttatttcttgtagctgtgattgcctgtggaagtgcaggaagggcggcttatgaagtatatgatgaattggatgtaaaagaatatctggtaagtcagaagaaagaatcgcattttattgaacagaattatgtggatccacgtacaacgaagattacatttccggaacaaaaaagaaatctgatttatatttatctggagtcaatggaatccacctttgcgtcaaaaggagatggaggaggactggattttaactgcattccggaactgacgactcttgcagaagaaaatactaatttttccgattcagataaattgggtggtggatatcctgcttatggaggaacctggacaatggcaggtattttttcacagacttcaggaataccgatcaagaattcggaacagacggatgatgtaaatgcaacacttgcagaacagtcttctttctcttcgcaggcaagaaacttagaggatattcttgcagatgaaggatataaccagtgttttatgattggctctgatgcgacttttgggggaagaagagcttactttgagagtcatggaaaaggacaaacagaaatctgtgattataatacggcaaaagaaaacggacagataccagaagattattatgtatggtggggatatgaggatcagaagctgtttgcaaatgcgcaggaaaaactgaccgaattaagttcaaaagatgaaccgtttaattttactatgctgacggtagatacccattttgaagatggatatgtatgtgaacagtgtcagaatgaatttggtgataaccagtatgcaaatgtaatggcatgttcgagcaggcaggttgatgcatttgtaaaatggattcaacaacagccattttatgaaaatacaacgattgtaataagtggggatcatttgacgatggattctgatttctgtaatgatgtcagtgaagattatgaacgtagtgtatacaatgtatttatcaatcttccagaaggtctggacacttcatttgaaaaaacacataacagagagtttgcaacactggatatgttcccgactacgttggctgcgatgggagtaacaattgaaggagacaggttagcacttggagtgaatctgttttctgatgagcagacacttaccgagcaatatggaagaaaaggccttgataaagagctgatgaaaaaatcaaaattctatgatatgctgatcaatgatgtggatattgatgcactacagaaaaagcgaaaggaagaggccgaaaaacagcaggaggaaaatgcagataatcaggaaaatacagacaatcaagagcagcagacgaatcagccggatgcaggtgtagatacaagtggtattgaaacgccggatgcatggcaggggtatacgcaggataattatcagtataattataatgacggatcgaatgattactggtatgacggaggaaattcctgggacaattcatggaatggaggatatgataataatacttatgtagaaccaactccaacgccggaaccgactccggatccaacgccggcaccggaaccgacaccaacaccagatccgacaccaacaccagaaccggctccggatccaacaccaaccccggatcctggaggagacacgggaagcgatacaggtggaacaacagaaaatgcaaattagagaagaactccggtttatgccggggtttttcttcggataaataaagcagaacggagttgtctgtaaattgatacaatgggaaattctacaaacaagtagacatttccccataaaaagtgtaagatagagtctaagagtatttatacttacaattatatggttagaaagaggaaagtacatgaagatgaagtttacgaaaaaaatagcgacaattcttttgtctgtatgtctgatcgtaccatgtttttctgtgatggcgctagctgcaaatggtgtgatattcttttctgatcttgagacaagtgtcggggatgaatttacgatcacaggtacagcagttgtcagcggagatgtaatcggagacgcgacgattcatatgacttacgatccttcttatatgcgatttgaagagggagacggagtgaatgcagacacggatggtaatctgacatttaaaggttcaggtgacggaagtagtgaccggattgagtttacaatgaaattccaggctctccaggaaggaagtacaagacttgaacagggagatgcgacggttacagacagcgctggatcaagtgtggcatgtgaagaaggatatgcggatgttacgatcggagcaggagatccgagcaagatcaaggatgttgcgagtggaacaagtgtcacgattgatggtcaggagtataccttatccggtgatttctcagacagcatgattccagctggatttacagcaggagagattacttataatgattcgacgtataaaggtgctgtgcaggaaaagacaggacttcagatggcttacctggtagacggtgatggaaaaggcgatttctggatgtatgattcatctgacagcagcttctcaccggcagaacaggttgtgatttcagatacttattctatcgtaatttttgatgcaggcagtaaagtgtctatgccatcaaagtatgcaaaaggaaatctggagatcaacggcaagacttttgaaatctgggatgaaccggaccgcgatggtttctacgtattatatgcagtaaataatgacggtgaagaatccctctatttatatgactctgtagagcatacttatcagagaatggagactccgaagtctgcgactacaccggataagaagagtgcaagcaagtttgacgcaattttagaaaagatttccgatcatctgatctggtttgtagcagcggcagcagttatcgttattcttctggtaatcttccttcttgtttccgttgtgaagttacataaccgtaacagagagttggatgatctgtatgatgaatatgaactggacgatgagccgcaacgtaatccggtaaaaccgatccagcctgttaaggcagaaaagaaatcacagttcaaaaagagacaggatgatgatttcgaagatgattatgacgacttcgatgatgatttcgacgatgatgattattatgatgatgacttcgacgatgattatgatgacgaaggaataagtgatgatactcgcagcgttgatgagtttgatgactattttgatgatgacgactttgattcgttcgatgattataatatcaagaaagaaaagcgtaaaaaaggtgatactttcgaaatggattttattgatctggattaaagagaaaggcggggatgacgattgttattcccgcttattctttacaaaaagtcccatatttgctacaatgtaacgaaaagagtaaaatttattttcgcaaaaaagactggaggatatagataaatgtgtggaatcgtaggatatgttggatcgcagcaggcggctccgatcttactggatggactgtcaaagctggagtatcgtggatatgattcagcaggacttgctgttcgtaatggaacagaagagacagaagttatcaaggcgaaaggccgtttgaaggtactgtttgagaagaccaatggtggtgcagccgttccgggaacctgtggaatcggtcacaccagatgggcaacacatggggaaccgtccgagaacaatgcgcatccgcatatgagtgacgatggcaatgtggttgctgtacacaacggtattattgaaaactatcaggagttaaagaacaagctgctccgcaaaggatatacattctactctgagacggatacagaggttgctgttaagctgatcgattattattataaaaagtatgaaggaacaccggtagatgcgatcaaccattctctggtccgcattcgtggatcttatgcgcttgctgtgatgttcaaggattatccggaagaaatttatgtggcaagaaaagacagtccgatgattcttggcgtaggagatggagagagttttattgcatcagatgtgccggctattttgaaatatacaagaaatgtatactatattggcaacctggagatggcaaaggtcagcaaagaggaaattaccttctacaatctggacggagaagagatccagaaaaaaatgaaaactgttgactgggatgcagaagcagctgaaaaagctggttttgagcattttatgatgaaagagatccatgagcagccaagagcggttaaggatactctgaattctgtgttaaaagacggaaagtttgatctgacagatatcggattagcggaagaggatatccggagaacaagccagatttacattgtagcatgtggttctgcttaccatgtaggtatggtggcacagtatgtgatcgaggatctggtgaagattcctgttcgtgtggagctggcttctgaattccgttaccgtaagccaattctggatccaaatggtctggtgatcattatcagccagtcaggagagaccgcagacagtcttgcagcgctccgtgagacaaaagcgcagggaatccgtacacttggaattgtcaatgtagtcggatcttctattgcaagagaagcggataagatattctatactcttgcaggaccggagatctctgtggcaacaacgaaagcgtacagtacacagctgatggcttcttacatccttgcaattgagtttgccaaagtaaaaaatacaatcactgaagagcagtatgaaaattatattgccgaattacaggcaatcccggagaagatcgaaaagattattgaagataaagaaagaatccagtggtttgcagcaaagcaggcaaacgcaaaggacgcattctttgtcggacgtggaattgattatgcaatctgtatggaaggcagcctgaagatgaaagagatcagttatgttcattcagaggcatatgcagcgggagaactcaagcacggaaccatttctctgatagaggatggaacgcttgtgatcggtgtgctgacacagccggaattatatgaaaagacgatcagcaacatggtagagtgcaagagccgtggtgcatatctgatgggacttacaacttatggcaattacagcattgaggatactgctgattttgtggtttacattccgaagacagatgagcattttgaggcatcgcttgcagtgattccgctgcagctgatgggatattatgtatccgttgcaaagggactggatgtagataagccgcgaaatctggcgaaatctgtaacggttgaataaagtgatgcaggaagttccagcggaatttcctgttgaataaacgagatgaacgacataaaaatgtgccgttcatcttttttttcatattttatcacactttcatcacaattataggctaaactcttaactatagaaaaggaaaagaaaggagtcttgaatgatggacaatcagtacaattattacagaccagattcagatgaaaatagaggagcagacaatcagcagggattcggagcaggaccgcagcagaatccgaaagctccaaaaccgaaaaaaggttacgcaaagaaagtcgcacttgttgtaggtgctgcagtattattcggggcagttggcggtgtgacgatgcagggaaccagttatctgactggtaagctgcttggaaagaatacaaagagtaccgtaggcacaacaaagactgtatcgaacgcaaagcttacgacatctaccagtacagtaacttctgatgtatcagatattgttgagaatacacttccgtcaatcgtttctattaccaatatgagcgtacaggaagtacagaatttcttcggaggaatcagccagcaggagagtgaaagcgccggatccggtattatcatcagccagaatgattcagaactcctggttgttaccaataaccatgttgtagaaggaagcgatacacttactgttacatttaatgatggtaacagcgtggaagcgcagattaaaggaacagactccgcaagggatcttgcagtcgtagctgttccgcttgataagatttcagacgatacaatgaatgcgattaaggttgcaacacttggagattcagattctctgaaggttggagaacctgctattgcaatcggtaatgcacttggttatggacagtctgttacaactggtatcgtcagtgcaaccggacgaacaattgatggatttgacggagaatacatccagacagatgcagcaatcaaccctggtaacagtggtggagctcttctgaatgcaaatggtgaggtaatcggtatcaactctgcaaagatcaacagctcggcagtagagggtatgggatttgcgattccgatttctgatgcaagtgatgttatccagaatctgatgaataaagagacaagaagcaaggtttcagatgaagaaagaggatatcttggaatcaagggatacgatgtatctgaagaaggtgcacagatgtacaatatgccgaccggtgtttatgtcaaagaagttatgagtggtggcggatctgagaaagccggtcttacaaaaggatcgatcattactggctttgagggaagttccatcagtggtatgagttctctccaggaacagcttcagtattataaagcaggagaagaggtaacgcttaccgtacagatcccggataagaatggtgaatatacagagaaagatatcaaggttacacttggtaaaaattcataaaatgatgtgaacacgtcgttttatgggagtatgaggttgttcgaggattgcgggaattacatagcaatggagcaatccggttacatcataaaatactaaagaaagatgccgtcagatcagaaatggtctggcggcattattgatgttacgacctgtttgaaacggaaacgggcatcagattataccggatgcaaaagtcagaaccctttttaaaaaattaccatacaataatattgcagatataagaaaggggagccaaaacaatgcaaaattgcagaaataataatccatatatgagacgtgcaaattgtggatgtggcaataataacaatagctgtaatagtaattcatgtatggcgaacaatgatggaagaaatccatcgatgtcagcacctgtttaccgagaacgatctggatgtagcgaccgggacgatgcgttggatggaatgtcgatcgcaatggcttatgtgccatggcagagttggagacacatttacgaagctggaaaaggattccacagaggaaccatattcgaagagcttgatcttccgtttaaggggaaaggaggatgtaacgcatgaatgaaatgccaaattccaaaccttgtagaaaagatctcctgatgcagattggtcatgcgagctttgcggtagatgatgtgaagctttatctggacactcatcctcgtgatcaggaagcgctggactttttttatgaatataataaaaaaaggaaccagttgttgaaagaatatgcaaaatattatggaccactcacagtagataccgctgttccttcctgctcagacagatggaactggattcaggaaccatggccatggcaggaaggagggtgttagtttatgtggaattatgaaaaacgtttacaatatcccgtaaaaattacccagaccaatccgaagatggcccaggtaatcatcagtcagttcggtggaccggatggagaattagctgcgtccatgcgttatttatcacagaggtacaccatgccgtacaaagaagtgacaggaattttaaccgatattggcacagaggaacttgcccacatggaaatgatatgtgccattgtttaccagcttaccaaggatttatctccggaggaaattaaggcttctggttttgataaatattatgtggaccacacacttgcactttggccgcaggcagccagtggaacaccgtggacagcaacttattttcagtccaagggtgacccaattacagatttacatgaagatatggccgcagaacagaaagccaggacgacgtatgataacattttaaggcttgtaaaagacccggaagtatgtgatccgattcgttttttaagaaagcgggaaattgtacattaccaaagatttggagaaagtttaaggatcgttcaggataatctgaacagtaagaacttttatgcaatcaatccggagtttgatacggattcaaatagtagttgtggcaattaaaacagcgcgtatggaaaaacgtccccaattatgaaaatccggtttgataaaaaaggggctgtgaaaaaagcatagtcccgaaaaaaagaaggaccaagggtttattataaaccctaaggtccttctttctgttataattagcttgcaatgaaaattaataacataatctattctaacccaaaacaggcagttttgccactgctaattcaagattatctggacatctgtgatccagtgctgacttttgacaaatttatgggagaaattgaactggagaagtatctgaaaaatattccacaacattatacaggaagactcagatatgacccggtcagcatgctgaagacagttttgttcggatttatggcgaatggctatatatcattacgtgagttggaggaccagtgtaaagtcaatctccgcttcatgtatctcatggatcatcaaacaccttcttatcgtaccttcggctacttcattaacgaggtacttgctgattccattaaagaaatatttcaagacataaataaaaaaatcttcgagacagaacatgtggatctccaacatctatacatcgatggctccaagtttgaagcaaatgcaaataaatattcctgggtgtggaaaaaagccacagaaaaatccagataccgtctctttgataagattactacactctttgaggaaatcaatgaagaactgtcatgtacagggataaagctttgtatcaatagtgagtatgcacctgagtatctgaagaaagcgactgaacagtatgcagaagcctggcagattgatgaaacgatgtttgttcatgggaggggacatcgcaaaaccacgcagcaacgtcattatgagaaacttagggagtatgctgtaaaactagaagaatacgtggaaaaaatcaaaatctgtgggaaggaacgcaacagctactcaaagacagatcattcagccacttttatgcggatcaagacggactatatgggaaatgaccagctgcttccagcttacaatgtgcaggttggtgttgcggatgaatacattgctgttgttgatgtaaatcagtatcgctcagacatggattgttttattccgttgatgaacgagttttatactacatatggcttttatccgaagtatccagtggcagatgccggatatggttcttacaacaattacatcttttgtgaacagcatggaatggaaaagtatatgaaattcaccatgttcaagaaagagactactgacaggaagtatcgtgaagatccattccgagcggtaaattttccaattggtgaagacggaatcatgcgttgtccaaacgggaaaaacttttatcttcggtatcgaaaaaacgtaaagggaaacaagtatggacgtcaggaagaatactaccagtgtgaggactgttccggatgtccatacgcagaacaatgtaaaaagacagataaaaaccgtatcgttcggatcaaccgtgaacttacagcgatgcatcaggaagtaattgaaaatcttgaaagtatccagggagcacttctaagaatgaatagatctattcaggcagaaggtacatttggcatcatcaaaaacgaccgttggtacaaaagaattgtccgaagcggaataaaatctgttctgctggaagtatttcttgtttctattggacacaatctttataaatatcacaacaaacagaaaaaagttgcaactgccgcataggattccataatagctttcttatggggaaaggggagttatacacttttttatgaactataactactgttgtattcataagcaaaggacgcatgaaaaaactttcgttttttcacacgcccttttttaaatgcctgcctactaatgttattctgtatataccatgctgatatgcgataatgcataagttctaccagtatctaataattaacgaggggaatgatcctggatataatcagccagcatcgaaataaattcggatgcggtcggtttgtcaaatacaggataaccaagcagcgggcttaaaattttattggaattctgattccaataactgttgatcattgtacggatggcggcttcaacacacatgttggaaacgccatactgctcaccgacaacgcggtaaagattagaggttacgttcttcaggtaaaattcctgatctttgagaacgagggcgactgctgaagcaagatagttataaccagagtacgtagaacgaagaccggcttttcttaatacatgcctgacatcatacataagaacctccttcaaatattcataccgactatctgactatagaataaaggaattctatagatatgtaaataattttgtccataacgatatatttcgtgagatttcgacatattgtgtgaagtggataatggaaaaatctgcttttttttgctataatccttaattggatagaacagacagaatcaatttcaggagtgaaatttatgaagatacaatatcagaaaatagaaaacggacttgaaattctcaggatctggcaggattcaggaatcataaaagtaccggagcagatagagggaatccctgtcatccgcattgctccatatacattttcactgcataaagatgaagaagagaaaaatgcatctgtttatcagactgagacagatgaagaggatgatcgttttgcgcaaccggaagaactctgctgtggtggaatggtaagggagatccatcttccgtctaccgtacagtcaattggaaattatgcgttttatggatgtatgaatctgaaacttttccatgggacagatgcaatcgtgcggatggggagcggggtatttaccggatgccgtctggagaaggtggagattgattttatggatggaaataagtcctgtcttaaggaaattctgacggagatccggtatcagatcattgcaacactgcgttatcagggaacggagacgaagatcctgtttccggaatattacgcagatgcggtggaaaatacgccggcgcggatcgtggagacgcattattatggttccggtggagagtacagggagtgcttttaccggcgggaactggattatggaaaatacgaccggctgtttgcactttctgaagcaagagattcggaagaggcaattttcagtgtggctctgatgcgtctgcgatatccgtggaagctggaagatgcggcaaagctgcgctatgaaaattatgtaaaggcgcatatggaagaaattggagaaagctgtatccatgcggtgaaagaaagacgcgaaatcgccgccggagatccgcaggaggttctgcttttttgctgcagagagcattattttgatgaacaagcgttgggaaaaacgattacttatgcggcagatgcaggacagaccgagatttcagctattttgatggacgagcgttaccgtagttttccaaaaaagaagaaaaagtttgtattgtaaaagaaggtggaaagattggaagaaatgtcattagaacagggtctggaagaaatcggacataaaatactggttctgacgaggaacgaactgtatatgaagatgagatttatggatgtggcgctttcggcgttttattatgtacaggatttttcggtagaccttcttgctacagacggagagacaatgtattttaacgggcagatgctgggaggtgagtacaggcagaaccggatcgaggtaaaccgcgcctatctacatctggttctgcactgcattttccgacatgtatttcgcagaaatggacgggaagagcttgtatggaacctggcggcggatattgcggtagaatctgtgattgacgactggaacctccagaatatacgaaaaagccagtcctggatcagacagagaacctaccgggatctgaaagaggaaatcaaggtatttacagcggaaaaaatttatggagtactggtaagatggaagctttcggacagagagatggagcgcatggcccgggaatttaccgtggatgatcacaagtactgggcaaaagatgaagatgatgaaaaacaaagcgaaatgaaccagaggtggcaggatatcagcgagaaaatgcagaccgatatggaaactttttcgaaagaagcagcatcaaataccgggcattttctggatcaggtccgggttgagaaccgacagcgatatgactaccgcagctttttgcataaatttgctgtactgaaggaagaggttaccgtggatgatgacagctttgattatgtattttacagttatggactgcgcctttatggaaatatgcctctgatcgagccacaggaatggaaagaagtgaaaaaagtggaggattttgcaatcgtgatcgatacttccatgtcctgctcaggagatctggtaaaaaaatttctggaggagacctatggcattttaagtgaagcagggagcttttttcagagagtcaatatccacattatacaatgtgatgaccaggtgcagtcggacaggaagattacctgtaaagaagaattacaggaatatatggaaaagctggatcttgccggggaaggtggaacggatttcaggccggcgtttgcctatattgatgagctgatcgcgacgcaccggttcactgaactgaagggtgtgatctattttaccgatggacaggggatttatccgcagaaaatgcctctgtaccagaccgcgtttgtatttatggacgacggggcagaagaacaggaagttccgccgtgggcgatgaaactggttctggatgaagaagatttgagaggagtgagaaatagatgaatattaaacgtgcaaaacaggaaatcaaggatgcggtgcaggcatacctgatgaaggatgaatatggagaatatcagattccggcaatccatcagagaccgatccttctgatgggacctccgggaattggaaaaacacagatcatggagcagatttcaagggaatgtgagatcggactggttgcgtatacgatcacgcaccataccagacagagtgcgatcgggcttccgtttattcagacaaagatctacggtggaaaagagtattcggtaaccgagtatacgatgagtgagatcattgctgctgtatatgaaaagatagagcagagcggcatgaaagagggaatcctgtttattgatgagatcaactgtgtttcagagacgttggcgccgactatgctgcagtttttacagtgcaagatgtttggtaatcagagtgtgccggagggatggatcattgtggcggcagggaatccgccggaatataataagtcggtgcgggaatttgatgtggtgacactggaccggattaagcggatcgatgtggaagctgattttgatgtctggaaggaatatgcgtatcaggttggaatccatcctgcagtgctttcttatctggaactccgaaaagagaatttctatcgtatggaaaatacagtagatggaaaaatgtttgtcacagccagaggatgggaagacctgtcaaggttgatccaggtttatgaaaagcttggtaaagaggtggatcgtgaggttgtgcatcagtacctccagcactggaagacagcgaaggattttgcaaattatctggagctttaccgaaagtatcagaaggagtatggactggagcggatccttgcaggatattatgaaaaagataccttagaacgtttgaaatttgcgtcgtttgatgagcggctgagtgtggtaaatcttctggtcggaaagatggcagaactttttaaaaaagaatatgagatggaaaaatttgtggagggactgtttgctcagctgtgtgcttataaagaggaattgcaaaagaaaggtgcagttccgggagaggtccttgctgcgaaaattcagtctcttaggcgggaagttgaacagaagaaggccgccggacagcttacaaaggcggaaatgcaccgtatggagcgtattttatgcaaattagaagaataccagaaagctccggaatttgagtctgtaaaggccacatttgacagcgaagaagagcagagagagcaaatggcagataagacactggaaacgctgaatcactgctttgaattcctggaatctgctttcggcgagagccaggaaatggcagtatttgtcacggaactcaacagtaatgtgtacagcattgcgttcctgcgggaaaatgactgtgcgatgtattacaaatacaacaaaggtttacttttggatgaacgccgtgaagaaatcctggaacagatggatgccgtggaaaatgtagtggaaagaggactggttgaagattaaagagcaagaactgacagaataagaacgactgtgcctgtggtatcatataatgatagaaagcagaagaaatgggaatgaaattcatgccagatctgcaattttgtaaggaacttcccgaaataaaaccaggggagtatcgcctgaaatatgatctcactttgcgcgtgtctcccggtcttggaactgcgttgtgccggggaaactatcaccgggagagctgcctgaaagcggaaagtaaggtgtatatctgccaaatcagatatttgagcagatctgtatggggattgatagagaatacggggtggatatgcctttatatgaatcataaatggctgataactactatagcataattataaaaatgacattttatgcctgacgagcctgttggagtgaaacttacatttcatgtagactctcgccaaaagcggaaccttttaagcgttggcttgctcagaaaaaggacgctgataatttcatatcaacgtcctttaaatctgtcagtattgggatatacaattatttattgtttacttcaagattcttcatcgcacgaaccttcagcggaagtccgaacagagtgatgaatccgcttgcatcatgatgatcgtacatatcaccagttgtgaagcttgccagagattcattgtaaagtgagtatggagaagtagttccggctttaatgatatttcctttgtaaagtctgaatttaacttcacctgtaacatatttctgggtagattttacgaaagcacgaagagcttcacaaagtggtgtgaaccattttccttcatatacaacctgagcgagtttgttgccaagatctttcttaacttccatggtagcacggtcgataaccagttcttcaagctgtttgtgagcttccatcaggattgttccaccaggagtttcataaacaccacgggatttcataccaacaacacggttctcaacgatatcaacgataccgataccatgcttgccgccaagttcgttgagtttgcggatgatatcagaaaccttcatagcttcgccgttgattgtcttcggaacaccttcttcaaatgtcatagttacatattcatcttcatccggtgcattttccggtgtatttccaagaacaagaagatcagcgtaatttggttcgcaggatggatcttcaagttccagtccttcgtggctgatgtgccataagttacggtcacggctatagctgtggcttgcgtcaaacggaagatcgattccgtgagctttacagtaagcgatctcatcgtcacgtgactgaagtgtccacagatctgtcattctccaaggagcgatgatcttaagatccggggcaagagccatgatagaaagctcgaaacggatctggtcatttccttttccggtagcgccgtggcagatagcagtagcaccttcttttcttgctacttcaacaagtctcttggagattgccggacgagccatagaagttccgagaaggtatgcattttcgtaaacagcatttgcctgtacacatggcataatatagttgtcacagaaatcatcagtgatatcttcgatgtataatttagaagcacctgcgagttttgctctttcatcaagaccatccagttcttcgccctgtccgcagtcgatacagcagcagattacttcataatcaaatgtctcctttaaccaagggatcagtgtggtagtatcaagaccaccagaatatgcaagaactactttttctttcattgtatataaacctcctaaaaattttctttcgtcttcaattcacaacccactatacaccattttttatatttatgcaataataaaatgaaaaaacttttaaaaatgttatttttatgcaaataaaagtaaaaatatacataaaatatgcataattatgtataaaaaaagaaagagagtaataagaaaaaagaaggatagaagaagattaaacagaaaatataaagataaatcagaaaaatacttgacatttgcacaaaaatccgtaaaatataacaaaaagtaacaaggtaacacgctaaaggaagaaaggaaccggcgaaatgagtgatatgcataaaatgaataagaataacatatttgatttcgttctgacattgccggcagaaggcagtgtatttttcattcctacattcccgcatcgaccgtgtccttcaagggcacagaacagaaaattcaatattgcagatcagggaatgcgtgtatccaatatatacagcttaaaatgttcatttcggatggaatgaaaaagtgataggttttgttcagtcattgaagtattatgattcgatagtgaaaaaagaagcagaaaaggtatcgccgcatactctttttctgcttcttttatttatacctactaagaatatgaactgaaaagaggaaaaacgaaatggaattaagagccaccctaaaggaaaagaaataatcgtagtatcttccggtgcagtcggtatcgggaaaaatgtccttggaatcagcgagaagccggctggttctgtcaaacaggaatatataatagaagaaaaccaaaaggatattatgcttgcaagaaaaaataagatgacagagccactgatcgaccggcttcttctaaatgaaaacagaatccggaaaattgcagaggaggcgtttccggtgatctgtgaccggctttcggcaaaaggggtagagatccggggagacaaagtagcaaggcagattgatgagcggatcgcttgggcataggaaagcgactggggacaggaagcccttaccacgaaaaagtatgtgatctttggaaatggacaaattcgcggataagaagattgacaggaaaaaatctccattttataatttgaatggtacaaaagttaaggaattttgtttttatttttaagatgttggggtccaaaggtattttgacccctttgataccagattgctacgtgctttgcactctcgcaatcctcaaaaacatgggtatcaggacggatgaaaaaggggaagaatgaaaaatgctgtatgtaagctactatgattcgctgatcgggaaaattacgcttggagcacgggaggatgtacttgtcggtgcatggtttgaaggacagaaatactatatggacaagattatagaagattttgaggagaagaaagacttgccggtactggatcaggcagagtactggctggatcggtattttgcagggcaggatccggatccggaagaacttcctcttgcacctgcaggaagtgatttccgaaaagaagtatggaagattatcacaaaaatcccatatggatgtaccattacttatggaaagatcgcaaagatccttgcagtaaaacggggcgcgaaaagtatctcgccgcaggcagtcggaggtgcggtcggacataatccgatctctgtgattattccttgtcaccgggtcatcggaagcgacggaagcctgaccggatatgccggtggacttgaaaagaaagaatggctgcttgcacatgaagaagcgcatatcagataagtgatcatcaaaatggtggctcgtagtgagtcaccatttttgatgatctggagaaatccgtaagagtccgatcctgtattctattttccggatttttcacataaccatcggtaagcaatgatgcagatgatcacagacaataaggagccggtagcggttgcgagtcccatcggaaacagtgtatgcgggaaaatttttgaagtcagataaacacccggaatacgcacgcacaaaatagcgatcaggttatgtaaaaatgaaattccagattttccgcatgcacagaagtatccgctgaaactgaaatgaacgccggcaaaaatacaatcccagatatatccgcgaatgtactgtgcgccgagaagaataacggctgcgtctgcagtgaaaagtccgacaaccggagctgcgataaactggatcaatatagagacgaccagaccaaatccaatggcgatcatcatggcatagcgaagcgtctgctttgcacggtcatactttccggcaccgatattctgagctgcgagtgcagaaacagtcgaaagcatggaagacggaatcaggaacagaaagctgatgattttttccacaatgccgacagcagcggctgcgttcagtccgcgccggttggcaatgatcgtaataataatgaaagcaatctgaataaatccgtcctgaagcgctaccggaatcccaatattcagaattttgccaagcggttttttctgtgggcggaaacagtcttcggaaagagaaagtccggtctgcttacgtttaatggcaatcagtgcaaacagaacactgcacgcttgggaaagtgttgtgccaagcgcagcaccggaagctcccagatggaaaaatccgataaacagataatccagtataatattcaccgcacatgcaactgcgatgaaatacatcggacttttagaatcccccagtccgcggaaaatcgaactgatcacattatacgccgtaataaaaggaatcccgagaaaacagatcgtcagataagctgccgttcctgacacagcctccgcaggtgtagacatcacggcaacagccggcttcacaaaaaacagaagcaaaaccgacagcaccagagaaatccccataaacaaaatcaccgtatttcccacaaacacagaagcccttttcttatcgcccgctccaatagactgcccgattgaaaccgtagcccccatcgcaagccccacgatcatcaccgtcaacatatgcatcacctggctcccaatcgaaacagctgttgtactggcaaccccatcaaactgcccaacaataaaaagatccgccatcccataaagcgtctgcaaaaaataagataaaaaataaggcagcgaaaaataaatcacattccgaaaaacactccccgaagtaagatcccgttccataaaataacaactcctttacaatcacttccttaatactaactgaattttcctaaaatagtcaataaaaagaatacagacctaatgcatcttataataataaaaatgcataataatgcataaaaataaatataaatgcataaaaataagaaattatacataaaaatacacagaaacatgcataaaaatcaaaaaaccacttgctttcccaaataaaaccatgtatactaaaccaatcggaaaatgttcccattcgtcagtgcacagttcctgcgcgaaatatctttgctaagcaacccctcgaaaacgccggcacttggcaaggcgagcgtaagcaaagccgagcctagtaccgctgcgtttgagacgcgccgaagaaatatccactggatatttctttaagcatgcatggcaagcgcaagcgcggttgcgtgcaaacatatttcgcgcaggagcgtccccgcaccaatcaaaaaaacattcctccaattcccgcgaacccctttacaatagggattaatgggtttatagtatttatgattatgcctatctatacacaaatacggcatttacgaaaggatggtttacatgattaaagcaggaatcatcggttctaccggttacgccggaggagaactggttcgcattttaacaggacataaagacgtagaaattaaatggtttggctcaagaagctatatcgataagaaatatgcagatgtataccgcaatatgtttcagatcgtagatgcggtatgtttagatgataatatggaacaacttgcagatcaggtagatgtgattttcacagcaactccacagggactgtgcgcatcattagttaatgaagaaatcttatcaaaggttaagatcatcgacctgagcgcagatttccgtatcaaagatgtcaagacttacgaaaaatggtacggtattgagcacaagagcccgcagtttatcgaagaagcagtttacggactgtgtgaagtgaacagagaagatatcaaaggcgcaagactgatcgccaatcctggatgctatacaacatgctccatcctgactgcttatccgctggcaaaagaaggactgatcgatatggatacgctgatcattgatgccaagtccggaacatccggagcaggaagaggggcaaaggttccgaacctgtactgtgaagtcaatgagaatatgaaagcatacggtgtggcaacacacagacatacaccggagatcgaggaacagcttggatatgcgagcggcaaagaggttgtgatcaactttacaccgcatctggttccgatgaacagaggaatcctggcaacagagtacgcgaagcttacaaaggatgttacctgggaagaagtaaaagcagtttacgataaatattatgcaaatgaaaaatttgtacgtgttctggagaaagatgtttacccggaaacaaaatgggtagaaggaagcaattatgtcgatatcggatttaagatcgatccgagaacaaaccgtatcattatgatgggtgcgatcgacaacctggtaaaaggtgcagcaggacaggctgtacagaatatgaacctgatctttggacttccggaaagtgaaggtcttgatctggttccgatgttcccgtagaacacggcagaaaaagaaaaggaatggaaaatatatgacaacaattattcgtgcgatgacagtagaagattatgaccagcttcatgcactttggatgcggatcaaaggatttggaatccggagcatagatgattcaaaagaaggcgtggaacgattcctgaaaaggaatccgacaaccagtgtgatcgccgaaatagacggaaaagtagtaggaggaatcctctgcggacacgacggaagaaccggatgtttttatcatgtatgtgtagatccggcgtaccgttgtcatgggatcggaaagagcatggttgcctatgcaatgtcagctctgaaagaggaacatatcaacaagatcacactgatcgcatttaccaagaatgatatcggcaatacgttctggaatacgatcggatggaccaagagaccggatgtcaactactatgagtttgttttaaatgaggaaaatattacagcatttatcgaagagggctaaaggaggctatatacgatgaagattatcgaaggcggtgtgaccgcagcaaaaggatttgaggcagcatcaacagcagcaaagatcaaatatcaggacagaaccgacatggcaatgatctacagtcaggttccatgtgaatgtgcaggaacatttactacaaacgttgtaaaggcagcatgcgtaaaatgggatcagcaggttgtaaagagcggtgcgaaagcacaggctgtgatcgtcaattccggaattgccaatgcatgtaccggtgcggaaggatttggctactgcaaggacacagcagatgcggcagcagaagctcttggaattaatgcagacggtgtactgatcggatcgaccggtgtcatcggaaagcagcttccaattgatcgcatcgtggcaggggtaaaggctcttgctgaaaagaaaaatgatacactggcaaacggaactgaggcagcaaaagcaatcatgacgactgatacctgtgaaaaacagatcgcagtagagatcgaggttgccggaaagaccgttaccatcggtggtatggcaaaaggatctggtatgatccatccgaatatgtgcaccatgctcagctttatcacaacagatgcagcaatcacaaaagaggcacttcagaaagccctcagtgatgatgtcaatgatacatacaatatgatttccgtagacggagatacttctacaaatgattctgtagttcttcttgcaaacgcaatggctgaaaatgaagtgatcacggtagacagtgaaagctataagacctttgcggaagcattgcatgagatcaacgaataccttgcaaagaagatcgcaggggacggagaaggagcaactgctttatttgaagtaactgtagttggtgcagatacaaaagagactgcaaagacacttgcaaaatcaatcgtatgctcaaatcttaccaaggcagcaattgcaggacatgatgcaaactggggaagaatcctctgtgcaatgggatattccggagcacagtttgacccggaaaaggtggatctgttcttcgagagcaaggcaggaaagatccagattatcgaaaatggtacagcggtagattacagtgaagaaaaagcaacggagatcctctcacaggaagaagtaaaagcagttgctgatgtgaagatgggaagcgaaagcgcaaccgcatggggatgtgacctgactcacggatatattgacatcaatgcagattacagaagctaggaggtaagcaaaatggatcaggatatgcagcagtatctggacaaagcagaagttctgattgaggcgcttacttatattcagcgtttcaaccgtaagatcatcgttgtaaaatacggtggaagtgcaatgctggacgaagaactccagaaaaatgtcatcaaggatgttacattcttgaaattggttggattcaaaccgatcatcgttcacggcggtggaaaagagatcagtaaatgggtaagtaaagccggaatggagccgaaattcatcgacggacttcgtgtgacggacgcagagaccatggaaattgcagagatggtactgaacaaggttaataaaaatctggttcgtatggtcgaagaacttggtgtccgtgctatcggtgtcagtggaaaagacggcggacttttaagagttgataaaaagctttccatgacaggacaggacgttggatttgtaggagatatcaagaaggtcaatgcagaggttcttctggatcttctggataaagattttctcccgatcgtatgcccggtcggaatcgatgatgattacaacacttataatatcaatgcggatgatgcagcttattcgatcgcaaaagcggttcatgctgagaagcttgcgttcctctctgatattgaaggggtatacagagactacgaggataaatcttctttgatcacagctcttactgtagatcaggcgaatgaactgatcgaaagcggagcaatttccggaggaatgatcccgaaactgcagaactgtgtaggagcgattgaaaacggagtgtccagagtccatattctggatggaagaattccgcactgcctgcttcttgagattttcacgaagaaaggtatcggaactgcaattttaagaaacggtgaagaagattaaagggaagacaaagaaagaaggtaattcttatggcaaatcagtatatgcaggaagaggacgacgcgattttaaaaacttataaccgttatccggttgtactggaccatggagacggcgcatacctctatgatccggaaggaaagaaatatctggatttctcagcaggatatgcagtatcttctctgggatataacaacaaggaatttaatgatgcattaaaggctcagattgacaagatgatccatacatcaaacctgtattataatacaacctgcggtaaagcaggagaagatctgaaaaagatcaccggtatgtacaaggtattcttcacaaacagtggtggagaagcaatcgaaggtgcgatcaaaactgcaagaaaatatgcgtacacaaaaaaaaccggacgttatgaatttattgcaatggagaattcattccacggcagaagtatgggtgcagtagcacttaccggacacaaagaatacagagagccatttgaaccggttatgcctggtgtacattttgcaatctacaatgatcttgacagtgtaaaagcactggtaaatgataagacctgcgcgatcattctggaaacaatccagggcgaaggcggaattaacgcagcgacaaaagaatttatgcagggaatccgtaagatctgtgatgagaacggaatcctgatgatctgcgatgaagtacagtgtggtatgggacgaagcggtgcatggtttgcatggcagcagatgggaatcacaccggatattatgacaatggcgaaagcaatcggaagcggtgttccggtcggcgcatttgcgatgacaaaagaagttgcagataattcgctggtaccgggagatcacggaactacatatggtggaaacccactttgctgtgcagcggtcagcaagactattgagatctttgaaaaagagcatatgctcgatcatgtcaatgaaatcgcaccatatctgacacagaaactacaggaaatcgtggatacctgcgatgcagccgttaaagtaaagggaagaggattgatccagggacttcagatcaccaagccgctgggtgaagtgacagtcaaagcgttggaagaaggacttctgatcatcggagctggaacagatgtgatccgaatgatcccaccgcttgttatcggtaaagaacaggtagatgagatggcagagatcctgaaaaaagcacttgcataaagtcggtgcctgataaaaataagagaataaaagagccggtcatcggatatactttcagaagaaaaggaggtatgaaagatgaccggattttttattgccctgctgtcgggagcgctgatgagtgtgcagggggtatttaacacacaggtaacaaagacgacaggaatgtgggtgagcaatgcctgggtgcagtttagtgcatttgccatctgcctggtaatgtggctgatcatgggaagggacagtattgccacgataggagaggtgcagcctaaatatatgctgcttggcggtgtgatcggagcagggatcacttggaccgtgatcaaaagtatggcgcagctcgggcctgcaaaggcggcacttctgatcgttatgtctcagcttattgtggcgtatctgattgaactggtgggattatttggtgtggaaaaagagccattttcctggagaaaagtgatcggtatggggatcgctctgatcggcacgacaatttttcagtggaaataggttgtcttttggaaaaaaattcgttacaataatcatgtcttggaagtacgaggggacatgctctgcggaaaaggagtatgtatgcggaaaagaagacagattttatatcaaatatgtggaattttccttggaatcagctgtatgctgtcagcatgccatgaaaaagaagagacctttaccagtgtggctgctgtagaagcggatgccggggataagaaaaacgaggcagaatcaaaggctgccgaagaaaagccggataaggaaaaagcagatccgggtggtgaagaaaaagaaggttcgatctgggtgtatgtatgtggcgaggtggcatcacccggtgtatatgaactgcaggaaggagaccgcatcacgcatgccatagaagcagcgggaggtctgacggaggcagcaggacaggtttatctgaatcaggcagcacatctgacagatggacaaaggatttatgtgccatccagagaagaagaacagactttgaaagaagaagattcaccatcggatatggcagatgccgggatggaaaaagacacaggaataataaacctgaacaccgcgacaaaggctgaacttttaagcttaagcgggattggcgagtcccgcgcggaagcaattattgcttatagagagacaaacggtggattcaggaagatagaggatctgaagaaagtggacgggatcaaggaaggaatctttcagaagatccgggagcagataacggtagagtagaggagtgcgcaagatgggcagaaaagtattggtagtagatgatgaaaagctgatcgtgaaaggactgagattcagcctggaacaggatgatatggaagttgactgcgcatacgacggtgaggaagcacttgagatggtaaaaagaaaagagtatgatatgattcttctggatgtcatgcttccaaaatacgatggatttgaagtatgcagacagatccgtgatttctcagatgtaccggtcatcatgctcactgcgaagggcgaggatatggacaagatcctcgggttggaatatggcgcagatgattacatcacaaagccgttcaacattcttgaggttaaggccagaatgaaggcaatcatgcgcagggtcgctaaaaaagacgggatgagcgcgagcggtaaagttgtggtaaagggagatctgaagatcgactgtgaaagccggagagttttttccggggacagggaactgaatcttaccgcaaaagaatttgatcttctggagcttcttgcgatgaatccgaacaaggtttacagcagggaaagtcttttgaatattgtctggggatatgagtatccgggagatgcaagaacggtagatgtacatatcagacgactgcgcgagaagattgaagtaaatccaagtgatccgaaatacgtttacacaaagtggggagttggctattatttcaggggttaaattttttgtaccaaaattcataaaaagtctgcaagtgcgggtaacggtgatcttgagcgtatttgtcatattatccagtgtgatcctgatgaatgcgattctgcaaagctatgatcagagaaccgtatccgtgcgcacagcagagattcaaaaccagtgtacgattctgagtaatcagctggtcaattctgattatctgaaaacgggagtttctgatgtgatcgatacagaactatcacagttatccaatatttacaatggaagagtgcttgttattgatgatgaattccggattgtggaagatacctatgatctggaggagggaaagacgatcatttccgaggatgtagtcaaatgcttccgcggcgagaagccggcaagttatgacagaaagagccggtacattgaagtggcagtcccggtcaaaaaaggggaagagccggtaaaaggaatgattctggttagtgtttctacagacagtctgcgtgacaatgtagaggcattgcagacaaaggcaagaattgcaacggttgcaatcagtattatcgggatctttttatcagcaatcatcggtatgctgcttgtaaggccgctgaaaaggatgtctcaatcgatcgaggagatggcaggaggctatggagataattatctccatgaaaatgcttacgatgaaacggaacggatttccaatgcatttaataagctgtgggaccgctataaagtactggatgcatcgagagaagagtttgtggcaaatgtatcccatgagttgaagacaccgttgacctctatgaaggtgctggcggattcactgctgatgcagccggatgcaccgacggagatttaccgggaattcatgggtgatttgtccgaagaaatcgagcgggagaataagatcatcaatgaccttctggatcttgtaaaactggataagaagggtgcaaacttaaatattaagagtcaggatgttaatgaactggtagaacggattctcaaaagattacagccacttgcggcaaaaagtaatattgaactggtatttgagagttttcgtccggtgacagcggaggttgatgaggtaaagattgcacttgtgatcacgaatctggtggaaaatgcgatcaagtacaataaagagaacggatgggtacacgtgtcgttaaatgcggatcataagtatttttatctgaaggttgcggattctggaatcgggattccgaaagaagatacggatcatatattcgagcgatttttccgtgtggacaagtcccattctcgtgagatcggcggaaccggtcttgggctttcgattgcaagaaatgcggttgtcatgcaccgcggtgcaatcaaggtctacagtgaaccgggagagggaacgacatttacagtccggatcccgcttacttatatcaagagggaaggatgagaagaatgaaaaaaatttaccagatcataagcattcttcttgcggtgtgtctttttacaggcattgtgggatgtagaaaaaaggaacagaaagcagatgcaaaatacacgatttaccagattaaccagagcggaacggcgttggttccgaaggactacgatggaacaggaaagtcggtggtcgaagaagtaaaaggaatgctgtctgcgctgcagaagtgtgatgacgaggtgaaggcacaggcggcattgccgaaaaaggtaaaactggagagatacactctggaggatgaaaagctgatcctgtactataatgctgcttacggaaagatggatacggtaagagaggttctgtgcagggcagcgcttgtccgttcactgacgcagatcgatggagtggatctggtgatgatctgtgtagatggaacgccacttacggataaaaaagggaatacttatggataccagcaggcagaagattttgtacagaacacaggctcttctattaactcttttcaggagatgaagcttacgctgtattatgcagattcatctggagaaaagctgcaaaaggaagaggatacggtgcggtataacagcaatgagtcgaaggaacgggttgtagtggaacagctgatgcgaggaccatccaataacagactgcttgctaccataccaaaaggaacaaagctgctgggtgtgtcgatcaaagatcatatctgctatctgaattttgatgaaggacttcggaacattgctccgggagtcagtccggagacggtgatctatgccatcgtaaattcagtgatcgatggtggaaatgtctctgaagtacagatttcaatcaacggagacagcagtattgtatatcaggagagtataaagctggatgaacctctgagcagaaaccaggaaatgataaaggaggattgatcggttgatcaagcgaagacttggttttgccggaatacttctggcaggactgattctggtactgtatctgacagggggaggaaagatttttggaagactcggtgtgtcaaggtgtgagaagctctggaaagagtcggaagaagtgatggtggaaggagaggtttatcagaaaaccagaaaagaagaaaaactgatcctgtatctgaaaaaaatacagatcagagagatggggaatggaaaagcagtcgctgacgagaggctgcttgtctatctggatgaaaaaggaaatggtccggaaatcggacagcggatcctggttaaaggcaatgtgggattttttgatccggcggccaatccgggcaattttgaccagaaaaattattataagcagcagaatatccaggcagtcttatggaaagggaaggttctggaaaaacaggtgaaaaagacttccttccgcgaaaagctgtggcagtttaggaaccggaccgcagatgagatctgcagagagatgggaaagcgtcgagggggtattttgtgtgcggttcttctgggagattctttttatacagaagagaaagtgaaagaactttaccgggtggcagggatcgggcatctgcttgccatatccggtctgcatatttctttttttggcaacggactttaccgggggcttaggaaaaccggattttctattttacaggccggtgtagtgggaagtctgcttcttggaagctatgtggtgatgaccggaatgagtgtttcggcactgcgggcgtttaccatgtttctgatccggatgggagcagagctgacaggaagggaatacgatggattgacggcacttgggattgcggaaattggtttgcttctggcaaatccgttgcggctttttacggcagggttccagctttcttttgctgcggttcttggtatctatctgattggttcgggaaataaaaaaggcagattttcagacagtgtccggatgtcggtgaggctctggttttttctgctgccagttacattgtggcactattatgaaacctgcctgtatgcgccagcctggaatcttctggtaattccgatggcatccgtgcttctgctttgcgggagtgcagggatggcagtcatgctgattccgtgttgggcaggagatataatgcagagcgcactttggaaaataacagagtgtattttgcttttttatgaaaaagggagcggtctgctcctggaacttccgggggcaaggtggattccgggaagaccacggctctggcagattgcctgttattatggggttcttctattttatttgtggagaaaaaggaaggaaaagaaagagggcagacaaaccgggaaacaggtggtaagacagcttgtgacagctggaatcctgctcatcctgctcgggatcccaaagtggaaacgagggcagatggagctgactatgctggatgtgggacagggcgactgttttttctttcgggacggaaacggaaaaaattacctgatcgacggcggaagcagttcggtagatgcagcaggaagataccggttggaaccatttttaaaattccggggcgtaaagaggctggattatgtgtgggtgacgcatggggatgtggatcacttaaatgcagtggaagaacttctggaacggagaaagtatggagtagaaatccagtatctggtttttccggaacagaaatattgggatgaaaggcttattaaattatgtaatctggcagaagaggcaggaacgaaggtacgggtaatggagatggatactatttttctgtctggaaaattgaagatgcgttgtctctggcctggagaaggtgagccatctgaaaatggaaatgaaaattctctggtacttcacctgcaatatgaaaaaattaccatgctttttaccggagatctggaaaataccggagaagagctgttggcagagagaataaagaatctccggaaaaaaggagaacttccggcgtgttatgatctgctgaaagtcggacaccacggatcaagaaatgcgaccggcgaagagcttctggaagtgatccgaccacgggcagcattctgttcatccggaaaagaaaaccgttatggacatccgcatgcggaaacactggaaagacttgcaaaatggggcgtaagcctatataatacgaaagacagaggtgctgtcagtatgtatacagatggaagggaatatggtatccaaagtccatgaaaagtttgaatgaagatttaaagacaggacagtttaagcagatttatcttctatacggagaagaagcttatctgaaaaaattatataaaaaccgtttcgtcaaagcgatggttccggaaggtgacacgatgaattatcgttattttgagggaaagaacacgaacccgaaggagattatcgaccttgccgagaccttacctttttttgcagagcgcaggctgatcgttctggaaaataccggctttctgaaaaatgcgacaccggagctggcagaatatctgaagaacatgccggagaccacttatatgatctttgtggaatcagagctggataagagaggaaagctctacaaagcgatcaaggagaaaggtcatattgtagaactgaagcggcaggatgaaaagacactgatccgctggatccttgggatggcgaaaaaggagaagcttcagatgtcggaggcagcagtgcgctatctgcttgcaaagactggtaatgacatggagaatctcgggcaggagctggaaaaattattctgttactgcatgaaccacacggagatcacggtagcagatattgatgaaatctgtactacgcagatcggaaaccatatttttgatatggtagatgcggttgcagcaaaagagcagaaaaaagcgctggattactattatgatcttctgacactgaaggaaccgccgatgcggatcctctacctgctgaccagacagttccgtatcctgatggaggtaaaagagatggaccgtactggggttccgccaaaagagattgccgccaaggtgggaatcatgccattcctggtaggaaagtaccgggcacaggcgaaggcatttaccaggaaagagctgcgtgggatcgtagaagccggtgtacagacggaagaagatgtaaaaaccggaaagatgggagatatcctctcggtggaactctttctggtgcagtacagtagcaaacgggaaaagtaatcagatatagataagaagaaaaaggagagactgaaaatatgcatatggatcagaaaaagattcggaatttttgtattattgcacatattgaccatggaaaatccacactggcggaccgtattatcgaacagacaggtcttctgaccagcagagagatgcaggcacaggtgctggataacatggatctggaaagagaacgtggtatcacaatcaaatcacaggcagtccgcacggtttataaggcaaaggatggggaggaatatatctttaatctgatcgatactccgggacacgtagactttaactatgaagtgtcacggagtcttgcagcctgtgatggagcgatcctggtcgttgatgcggcacagggcgtagaagcgcagacactggcaaatgtatatctggcactggaccatgatctggatgtcatgccggttatcaacaagatcgatcttccaagcgcagagccgcagcgtgtgatcgaagagattgaagatgtgatcggaattgaagcgcaggatgcaccactgatctcggcaaagacagggcttaatgtagatcaggttctggaacagatcgtgacaaagatcccttctccgacaggagatccggatgcaccgcttcaggcactgattttcgattccctctatgatccgtataaaggcgttatcgtattctgccgtatcaaagaaggatgtatcacgaaaggaatgccgattcatatgatggcgacaggtgcaactgctgatgttgtggaggttggatattttggtgccggacagtttatcccttgtgatgagctttcagcaggaatggttggatattttacagccagcctgaaaaatgtaaaggacacccgtgtgggtgataccgtaacaggtgcggaaaatccatgttctgagcctcttccgggatataaaaaggtcaacccgatggtgtactgcggaatgtatccggcagacagctccaaatacccggatctgagagatgcactggaaaaactgcaactcaacgatgcggcacttcagtttgaaccggagacctctcttgcgctgggatttggtttccgctgtggtttccttggacttttgcatctggagatcattcaggagagactggaaagagaatacaatctggatctggtgacaactgcgccgggtgttatctacaaggtgcacaagaccaacggagaagtgatcgacctgaccaatccgtctaatcttccggatccgtcagaaattgattttatggaagagccgatggtaaaagcagagattatggtgacatccgaatttatcggtgcgatcatggatctgtgtcaggaaagacgtggcgaatatcagggaatggaatacatcgaagagaccagagcggtattgaaataccacttgcctctgaatgagatcatctatgatttctttgatgcgctcaaatccagatcccgcggttatgcgtcttttgattatgaaatgctcggctatgtcaaatctgatctggtcaagctggacatcctgatcaacaaagaagaagtggatgctctttcctttattgtatttgcgggaagtgcttatgagagaggaagaaagatgtgtgagaagctcaaagaagagattccgagacagctttttgaaattccgatccaggcagctgtcggaagcaagatcattgcccgtgagacagtaagagccatgcgtaaggacgtacttgccaagtgctacggcggtgatatcagccgtaagaagaagcttctggaaaagcagaaggaaggaaagaagcgtatgcgccaggttggaaatgtagaaattccacagaaggcatttatgagtgtattaaaactggacgacaaatagacagacaaaagataatcgggcaggctgactcctactcgattcgtatactttgtacactatctcgcttaacagctcgatgatgtacattcgccaagtacagattcttgtgcaagcacaaatctgtacttggctcatcgtatacacaaaaaggcaggagcgatttccgaggaaaggttcctgccttttgcacagaaaaggagaaaagcagatgcagcctttagaactatatattcatattccgttttgtgtgaaaaaatgtgcatattgtgatttcctttccggtccggccggagaaaaggaaaaagaggaatatgtgaaaatgctggtcgacgagatcagaaactgtccggatacagtgcagaattacagggtgatttccgtttttttcggaggcggaaccccatctcttcttaccggtgagcagattgggcggctgatggatacggtcagggaaatatttacgttggatgaggacgcagagatcactatggaaatgaatccgggaacggtaacggaagaaaaactgcgaaagtatagacaggcaggggtgaaccgtctgagtatcggtctgcagtcggtcaatgatgaggaacttcgtctgcttggaagaatccatacttatgaagaatttcgggaagcatatcatctggcgagagccaatggcttttcaaatatcaatgtagacctgatctcggcaattccggggcagacggtggaaagctggaggcgtacactggagcgggtaatggcactttccccggagcatatttctgcatatagtctgatcttggaagagggaacaactttctataaaaaatatgtagaagacgaggcaaaagaaggaccaaagcttccggatgaggatgcggagcgtcagatgtactgggatacggaaacgctgatggagaagaacggatatcaccgttacgagatttccaattatgctaaggagggatatgcctgcctgcacaacctgggatattgggagagagttccgtatctgggatttggaattggtgcggcatctctggttcccggggatctgattggaaaatgcaggaagctggaaggaaaaatgagtcgctacacgaacccggatcagctaagggagtatgcacattcctacaggaacaaatttcaggcagagcttctgacagaaactgaggagatggaggaatttatgtttcttggactgcggaaaatgaacggaatctcaaaaaaagaattttcagagtattttgggaagagtctggaggatatttacggtgaaccgatctgcaaactggaaagcttaaagcttcttgagcaagatgatgacagagtatggcttacaaaacgggggatcgatgtcagcaacagtgtgtttgtagagtttctgctggaagagtaaaatttggaaaatcagaaaaatataaagtatacttgacaaataggttttataggcatataatgacatcatcgagttaaacctatcaaaacagtaggaaagaaaggagaacttacgatgtcaaaaatttataatggtgctttagagcttgttggaaatactcctcttgtagaggtgaaaaatattgaagaagaattaggattagaggcaagaatccttgtgaaactggaatattttaacccggccggaagtgtaaaagacagaattgccaaagcaatgatcgaggatgctgaggaaaaaggattattaaaagaaggttctgttatcattgagcctacttcgggaaatacgggaatcggtcttgcatcgattgcagcagtcaaaggataccgtatcattcttactatgccggagacaatgagtgtagaaagaagaaacatcctgaaagcatacggagcagagattgttctgacagaaggcgcaaagggaatgaagggtgcgattgaaaaagcagatgaacttgcaaaagagatcccgggcagctatatccctggacagtttgttaatccggctaatccggaagtacacagaaagacaaccggaccagagatctggaaggatacagacggagaagtagatctgtttatcgcaggtgttggtacaggtggaacactgaccggtgtcggcgaatatctgaaatcccagaatccggatgtgaagatcgttgcattggagcctgcaagctcaccggtactttctacaggaaaaggtggtcctcacaagattcagggaatcggagcaggatttgtaccggacgtactcaacacaactgtatatgatgaaatatttactgtagaaaatgatgacgcttttgcaacaggaaagctgcttgcaaagaaagaaggaatcttggtaggaatttcttcgggagccgcactttatggagcgatcgaacttgcaaaacgtccggaaaacaaaggaaagacgattgtggcactgcttccggataccggagacagatattactccacaccgctcttcacggagtagaatatgaatttttcaaagaaaagcagatacggacttcgggcactgatcgacctgtccgtatactcgaaagaatcccatgttgcacttgcagcaattgcagagcgtaacagtatttcaccgcagtatctggaacaggtatttgcggcactcagaaaagccggaatcattaaaagcgtgaaaggaccgcaggggggatacctgttggcgaagcctgccacaaagatttcggttgcggaaatattacgtgcgctggaaggtgattatctcatcgaagaagaggatgtagaaggcgccgagaacggaagagctgcggctcaggctgtacagagtgaagttatcgaacgtctgaacagaggactacaggatatccttgagaatctgtttctctctgacctcgaacaaaaatatcaggaatacagtgaatatagtcaggatatgtactatatataatagaagaaatgcacaccatcagaccgggatgatatgctaccctcatataggacaatgaaatataaaagtcctatatgggggtattttcatgttcagaaagagtaagatagaaccagtagaaaaagtaaaaatagtcgaacgctaccttgcaggagaaattggcatacagcaagcaggaaaagaattgggagttgatcatcatagtattcgaaattgggtttctatttatcagtatgatggaccaactggattactcaatcaaccgaaaaacaaatcttattcaaaagatttaaaaatatctgctataaatgattatcttaacggagaaggatctcttcaggatatttgcacaaaatacggaattcgttcacacagacagctttccgattggattaaggtgtataattctggtggaatattaaaaacatccactggaggtgcttacatgaaaaaggcaaagaacactacacttgatgagagattaaaaatagtaacagattgtcttgcaaatgataagaattatggtgcaatggcactcaaatatgattgttcctatcaacaagttcgcaattgggtaatacgatacgaaaagatgggtcaagcgggtctggaagacagacgtggacgtcgtatagcttctcttccaagcagaacacctgaagaagagctacgtgacaagatagctgaactggaaagaagaaatctagacctacaaatggagaatgatctgttaaaaaaagtcagagaactggaaaggaggggtcgctatctttaatccatcggttagccgaatatgaagccatccaaaaactatcgtctactaagcattatcccatagatagactttgtaaatatcttaatgttacacgttctgcgtattaccgctggggaaaatatccgaaaagtaataatgaacttcgaaacgaaagactatccactgaaatccaaaggattcatcaccagcatccagatatgggataccggaggattcgtgatgaattagatggacataaaggaattcatgtgaatgataaacgagtacttcgtatttgtaggaaatacgatataaaatcaaatattaaatggaaacctaagagttgtaccagaggagacagaaatcctgatcacatagcaaaaaactatttacaccgtgaatttcacgccgaaaaaccgaatgaaaagtggcttacagatgtttctgaatttaaatactacaacggaatagaagttcataaagtttatctgagtgctattttagatttatatgatagaaggattgtttcctttaaaatcagcgatcataatgataatccattagttatggacacgtttgatgaggctgttcgtcaggagccagatgcacacccattagttcattctgatcgaggctttcaatatacaagcgcacagttttatactagattaaaaaaacatcatatgaagcagagtatgtctagagttgcccactgtattgacaatggaccaatggaagggttttggggaattctaaaacgagaaatgtattataaacagcgttttaatgacagaagctctttgattactgcgatagctaattacatagattactacaacaaccaacgacttcaaaggaaactgcatgtaatgacaccaatgaaatatcatgagcaatatacaaaagcagcataaaatatcgccagccatagcatggctgacgatacaaaaatttattattttttattgtcctcttgacggggagcataccaggaggctgaggtgtgtattttttggtttgacggtcgggtggggagtttgggaggaagggagcaggcggttcaggcagaaaagaagggattccgattcaatcggcaaaccattccgatgagcctccgacagcatatccgggtggaaccggactaaaaataaaaaaatcataaaccctgttgacaaagtgaatagtaagtggtacatttataagcgtagaaaatgttagcactcagacataacgagtgctaataacaaaaaggaggtagcatatggaagccatacaggaacttaatgagcggaagacgaagatcttacatgcaatcattaagaactatcttgagaccggagagcctgtgggatccagaacgatttccaagtatacggatctgaatttaagttcggcaacgatccggaatgagatggcagatcttgaagagcttggttatatcatgcagcctcacacatcagcaggaaggattccgtcggataaaggttacagatggtatgtggatatgctgatgagccagaaagaacaggagattaccgaaatcaaaggtcagatgcttgagaaggctgacaagatggaagaacttctgaagcaggttgcaaaggttcttgcgaacaacacgaattatgcgacgatgatttcgactccgacttacaacgggaacaaattaaaatttatccagctttcacaggttgatgaccatcagctgatcgttgtgatcgtgatggaaggcaacattgtaaagaaccagatcgtgacactggatgagccgctcagcaatgaagcactattgaagttgaatatgcttctgaatacttcgctgaacggaacttcactagagcagatcaatctgggagtgatcgcaagactgaaagaacaggcagggatccacagtggtgtgatgagcagtgtcctggatgcagtagcgaatgtgatccagctggatgacgacatggagatttacaccagtggcgcgacgaatattttcaagtatccggagcttagtgataagcagagcgcacaggagatcatcagtgcttttgaagaaaagcagcaacttgccgctctggtaacaaagtcaatggcaaacggcggtgaagacagagacatccaggtatacatcggagatgaatcgaatgtggagaacatgaaagactgcagcgtagtcacagcaacatatgagttgggcgagggcatgcagggaaccatcggaatcatcggaccgaagcgaatggattatgaacatgtcatgaagacgcttaagacactgatggcagagctggatgacatattccacagggatgagccgaaaaagctcgaataagaagtaagaaaggtggaagaaccattggataaaaagatgagtaatgaagaaatggtaaaagaagcagtggaagaagcaaagaaagctgcggaggcagaagccaaagagcaggaggcaaaagggcaggaaccggaagacgcggaagaaaccgaagcaacagaggaagaagctgttggtaaagagacgaattccgaagatgctgaagaaccaaagaaaaagaagctgtttgaaaagaagaataaaaaagataaaaaggatgagcagatcgcagatctgacagacaaacttacgagacacatggctgagttcgataattacagaaagcgtactgaaaaagaaaagtcagcgatgtatgagatcggagccaaagatgttgtagaaaaaattcttccgattgtagacaactttgaacgcggacttcagtccgtaccggaagaaaagaaagatgatccgttcgtagatggaatggataagatctataaacaaatgatgagcacactggaaggaatcggagtaaaaccgatcgaagcagttggtcaggaattcgatccgaatttccacaatgcagtgatgcatgtggaggatgaagaacttggtgaaaatgtagtagccgaggaattccagaaaggatatatgtaccgtgactcagtcgtaagacacagcatggtaaaggtagcaaactaagatataccgtgtaccgcatttacgatacactttatataaataacaaagcaaaatacaatttttattatattaacaggaggtcttcataatgggcaaaatcattggtattgacttaggtacaacaaacagttgtgtagcggttatggaaggtggacagccggtcgtaatcgcaaatacagaaggagcaagaactacaccatctgtagtagcatttacaaagacaggagaacgtcttgtaggtgaacctgcaaaacgtcaggcagtaacaaatgcagaaaagacaatctcatctatcaagcgtgagatgggtacagatcataaagtagacattgatggaaagaaatattctccacaggaaatttcagctatgattcttcagaaattgaaagcagatgcagaaggatatcttggagaaaaagttacggaagcagttatcactgttccggcttacttcaacgatgctcagcgtcaggctacaaaagatgcaggtaagattgcaggcctggatgtaaaacgtatcatcaacgagcctacagcagcagctcttgcatatggacttgataatgaaaaagaacagaagatcatggtatacgaccttggcggtggtacatttgatgtatctgttatcgagatcggtgacggcgttatcgaagttctttctacagctggtaacaacagacttggtggagatgacttcgaccagaagatcacagattatatgcttgcagatttcaaggcaaaagaaggcgtagacctgtcaacagacagaatggcacttcagagactgaaagaagcagctgaaaaagcaaagaaagaactttcttctgcaacaacaacaaacatcaaccttccgttcatcacagcaacagctgaaggaccgaagcattttgatatgactcttacaagagctaaattcgatgaactgacacgtgaccttgtagaaaagacacaggaaccggtaagacgtgcactttctgatgcaggacttacagcagcagacttaggtcaggtacttcttgttggtggatctacacgtatcccggcagttcaggaagaagtaaaacgtctgacaggaaaagaaccaagcaaatctcttaacccggatgaatgtgtagcacttggtgcttctattcagggtggtaagcttgcaggagatgcaggtgcaggcgacatccttcttcttgatgtaactccactttcactttctatcgaaacaatgggtggtgtagctacaagactgatcgagagaaacacaacaatcccgacaaagaagagccagatcttctctacagcagctgataaccagacagccgttgatatcaatgttgtacagggtgaaagacagtttgcaagagataacaagtccctcggacagttcagactggatggaattccgccggctccacgtggaatcccacagatcgaagttacattcgatattgatgcaaacggtatcgtaaatgtatctgcaaaagatctgggaacaggaaaagaacagcacatcacaattacagcaggatctaatatgtctgatgcagatatcgacaaagctgtaaaagaagctgctgaatttgaagctcaggataagaaacgtaaagaagcaatcgatgctaagaacgatgccgacgctatggtattccagacagaaaaagcacttggcgaagttggagataagatcgatgcagcagacaaagcagcagtagaagctgacgtacaggctctgaaagatctgcttgcgaaagcgaatacagaagaacttacagatgctcaggttgcagaaatcaaagcaggaaaagaaaaactgatggaaagcgctcagaaactgttcacaaaggtttacgaacaggcaggcgcacaggctggtcaggcaggaccacaggctggacctgcaccagaagcaggaccggctccggaaggatttaacggagatgacgtagttgacggagattacaaagaagtttaatccgtaagataagatgagaaactgcaaggcggcattataccgtcttgcagatttcatgtatcataaataaaaatagttttttatgacataaaaagcctccggttaggtgaactgcatgtgcaaagaagatgttgcagagagccggcgcgggcatgagaatgtgccagggtacattctgtattaaaatactttgagaaatatctaagtgaggtaggattatggcagaggcaaaaagggattattatgagatcctgggcgtatcacgagatgcggatgatgcgactctgaaaaaagcatacagagctttggcgaaaaaatatcacccggatatgaatccaggagatgcagaagccgaaaagaagttcaaggaggcttctgaagcctatgctgttctgagtgatgcagacaaacggcgtcagtacgatcagtttggtcatgcagcgtttgaaggcggtgcaggcggagccggtggatatggcggttttgattttaacggggcagactttggtgatatttttggtgatatcttcggtgatctgtttggcggtggcagaagaggcggacgtgcgaacaatggtccgatgaaaggcgccaatatccgtaaaggtgtccggattacatttgaggaagcaatttttggatgcgagaaggaactggatatcgttctgaaagatccatgtacaaagtgtaacggaacaggagcaaaaccgggaacaagtccggagacctgttcaaaatgtggtggaaaaggtcaggttgtttatacatcacagtcgttcttcggaacggtgcagaatgtgcagacctgtccggactgtcatggaacaggtaagatcattcgtgagaaatgtccggactgtggtggaacaggctatacttcaagccgcaagaagatcaaagtcacaatcccggcaggtattgacaatggtcagagcgtaagaatccgtgagaaaggtgaaccgggtgtgaatggcggaccgaggggagaccttctggtagaagttacggtttccagacatccaatcttccagagacaggatgttcatattttctcaactgcaccaatttcgtttgcgcaggcagcacttggtggtgatgtgcgaatcaagacggttgatggtgatgtgatctataccgtaaaaccgggaactaagactgatacaaaagtacgcctgaaaggaaaaggggtaccttctttgagaaatcctcaggtcagaggtgatcattatgtgacgctggttattcagaccccggaaaaattaagtccggaagccaaagaagtgcttagacattttgatcagttgacaggaaatacactgaaccaggaagagccggcttctgaatcgaagggtaaagctaagaaaaaagggttcatggataagttaaaagaaacatttgaagaataataaaaaggtggctgcgaaaaacccgattgagtttttcgcagccacttttttactattcttcttcgtcttccagttctcctccgatgacacctccgagaacggcagtgaaagaagcaacaacgacagcggcgatgattgctacaccgatcagtgctactaataaaatacccataacacgtacctccttttctcgtcctttttatagtataacacggaggcatgtaaaattaaatgaaaaaatgtgacttttttcatttagtatgctataatgtcaaagagcaaatgataacacagcgtattgtcagttttgcggatttaaaatagtaaggcttagcggttaaggagggcaaaccaatatggcactgaaaaaacagataaaagaaacaaaggcagcagaggtaaaggcagcggcagaaactaaagaagaagtaaaaacagcagttaaagcagcagaagataaagtcagcgaaaaagtagaagaagtaaaagaaactgctaaaaaagaagcacagccgaaagaagtaaaggctactgttgaaaagaaagcgcaggaggtaaaaaaagctgcaggagaagtgaaaaaaacagtagaagaaacagctgaaaaagctgcaaaagaagtgaagaaaactgcagagaaagttacaaaagaagtaaagaaagcagcaccaaaaacaacagcaaaaaaatctgcggcaaagaaagaaatcaaaacagaagttgttcttcagtatggtgaaaaagaagtaaacacaaaagatatgattgcttcagtaaaaaaagactggacaaaacagaaacataaaatttccgagatcaagagtattgagctttatgtaaaaccggaagattatgcagtgtactatgtaatcaatggcgaacataccggaaaagtatggttataagataagactgaaagatttagtccgaaccgcaatctttattgaacggttcggatttttttaaggagagaggtaaaatgcaaaagtttatacagtataccccgacagaaatcctgtttggagaaaacacacaggcagaagttgggaacgaagttaagaaatggggcggaagccgtgtatttatcgtatatggcggtggaagtgtaaagaaaagcggacttcttgcgcaggtagaagaagcactggaaaaagaaggacttgcttatgaggaatttggcggagtaaagccaaatccccggatggcatatgcacaggaaggcgttgagaaagcaattgagttcggtgcggattttcttcttgcagtaggcggtggaagttctattgatacagcaaaggcgatcgcccatggtgtggcaaacccggactggtctctggaggagatctggggtggtgaaatcacacttaccagatcgacaccggtaggatgcgtacttacgattgcggcagcaggaagtgaaacaagcgattccgcagttctgacaaacgaagaaacagggaaaaagggaggaatcagcaccggcctgaaccgcccgaagtttgcgatcatgaatccggttcttacctatacgcttccaaaatatcagattgcatgtggagtcgtagatatcatgatgcatacgctggaacgttattttattccgaatacgagaaatcagatgacagatgagattgcagagggagttctgcgggttgtgattgaaaatggaaagaaaggtctggagaatccgacagactacgatgccatgagtgaaatcatgtgggcaggaagtctttcacataatggtctgacaggtctcggaagagcaaaagatttttctgtacataagctcggacatgcacttggtgcaaaatatgataaggcgcatggtgcaaccctttcagctgtctgggaatcctgggcagaatatgtctataaaaacgatgaagaaagatttgcgcattacgcaaaaaaagtatggggcgtagaggaagaagatgtggcgaaagccgcaaaagagggaattcgccggacggtagaatatttccgtgagattcatatgccgacaaatttaaaggaactggagatcggagaagtatcagaggaagatctgcgggaacttgctatggctgcgacattaaatgacactgtaaaactttcaaaaatcaaagaacttactgccgaagatgtataccagatttttcggaaagcagcaggaaaataagatggaaataaataagagaaaattttacagacaagtgttcgcgcttgtaatcccaatggcacttcagaatctgatcaatgtgggtgtgacggcggcagacgtgctgatgcttggaagagtcagcgaaaaagttctttcaggtgcatcccttgcagggcagatacagtttgtcatgacactgatcctttttggtacaacatcaggtgcaacggttttgaccgcacagtactggggaaagaaagatacacagacgattgaaaaaatccttggaatgggaatgaccatcggtgtcagctgtgcagctctttttaccattgttgcggaaatcattccggaagtgctgcttcatatctataccagtgacccggccgtgatcgcagaaggtgtgaaatatttgcggatcgtggcgctttcctatgtcctgatggcggcaacgcaggtctatctttatattatgcggagtatcgagcaggttgtgattgcaacggttgtctacagcgcgtcactaatttgtaatgtcctggtaaatgcgcttcttatttttggcttatttggtttaccgaagatgggaattatgggtgcggcaatcggaactctgacagcaaggatcgtagaacttatcattgtaatctggtatgcaaaagtaaaaaaccatgacgttagatttcacccggtctatatgcgtaagatcgacaaggtgcttctaaaagactttctgatttatgcgagtccggtgatcttgaatgaaatgatgtggggacttggttctactgcgaatacagcagtgatcggtcatctgggaagtgctgcggtggcagcaaattctgttgctcaggttgcaagacagctggcaacggtggttgcctttggtgtatccaatgcgactgccatttatcttggtaagaccatcggtgcaaaagagtttcatctggcaaaagagtatggaaaaagatttttgtggctgagtattattaccggtgcggtaggaggcggcatcattctgatagctgctccgattgcaaatcatgtgatgacactctcacaggaagcgcaggggtatctttattttatgttttttgttatgtcttactttacactctgccaggcgatcaatacgacccttgtggtgggtgtattccgggcaggaggagataccaggtttggtctgatcctggatgtgtctaccatgtggggatgctctattctgctgggtatgatcgctgcctttgtctttcatgcgccggtgcaggttgtttatatccttctgatgagtgatgaggtgatcaaagtaccgatcacagtcatgcgctaccgaagctataaatggattcagaatgtgacgagagaaaaagcagagctggcataacattgtatgcgaaaataaatttggaattttgaggtagatgtgatatgctagagaaagaatatatttgaaaaggagatttgcaacatgagattagtatcaacagaaaaagcaccaaaagcacttggaccatattcccagggatatgtacatgggggaattctttattcggcaggacagattgcgatcaatccggctacagatactgtagaagctgatactatcgaaggacaggctgaccaggtatgcaagaacatcggagcaatccttgaagaagcaggaacttcttttgacaaagtattaaagacaacctgtttccttgctgatatgggagatttttccgcatttaacgaagtttatgcaaaatatttcacatcaaaaccagccagaagctgtgttgctgttaagacacttccgaagaaccttctttgcgaaattgaagtgatcgcagcagtggaagaataggatagagagatatcctgaaaaagtaggaggtttggcattatggcagaagaaaaaagcagcggatgttcgccggaatcatgttcttcctgtgcacatgcgggttcatgcagcagtgcgaagaaagatctgaaagcaccggcaaatccgtattcacaggtaaaaaaagtaattggagtagtcagcggtaaaggtggagtcggcaaatcaatggtgacagcatctcttgcacgtatgatggtacagcagggatattcagttggtattctggatgcggatatcacaggaccatctatcccaaagatgtatggagtgcatggaagtgcagtcggaagcgaggcgggaatgttcccgtgcgttgcaaaagacggcacgaagatcatgtcggtcaatctgcttctggaacacgaatcagatcctgtcatctggagaggaccggtgatcgcaggagtggtaacccagttctggactgatgtaatgtggggagatctggatttcttatttgttgatatgccaccgggaacaggggatgttcctcttacggtattccagtcacttccggtagacggcgttgtgatcgtgacttcgccacaggatctggtacagatgatcgtagagaaagcttacaatatggcaaagaagatgaacataccggttctcggactggtggaaaactacagttatctggaatgtccggactgtggaaagaaaatatctgtatttggggaaagccacattgacgagattgcagaaaaacttggggtagaagtactcggaaagatgccgatcgatccgaaacttgccgagattgtagaacaggagaagttctatgaggcagacaaccagtatcttaaaaacatcattgacaagttcaattaagaagaaagctccggcgaggtgatgatcgccggggctttttagctatagaggcacggaaaatgtgaaaagccatatcatggcaggacggatacaattggcaaggaacatgtgtttatggtatgataacaggtagcaaaaagcggaggcagaaagaacatggacgagaatctcccggtgatccggatttcggtgcgaaaccttgtggagtttattttaagagaaggggatattgacaatcgaacaggaggcggacaagatccggagaatatgcagatgggaagtcggattcaccggaagatccagagacagatgggatcggattatcaggcggaggtacctcttaagacagagatcgtctgtgatgggtttactttgaaaatagaaggacgtgccgatggactgattcatacaaaagagcaggtcatggtagatgagatcaagggtgttctgcgggaacttgaccgggtgcaggagccggcaggcattcatctggcacaggcaaaatgttatgccagcatggtagcagaacaggaaggggtggatgagatcggggtacagatgacctattgccagatggagacggaagaggtgaaaaggtttcagtattcttatcagagtaacgaactgaaagtctggttcgatgaagtgattcgacagtataaaaaatgggcaaagttccagattgaatggagaaaggcaagaaatgcatctattaaagggattgaatttccgtttccatatcgtaaaggacagagagatcttgcggtatctgtttaccggacgattcttcggaagaaaaagttgttcatccaggcaccaaccggagtggggaagacgatttcaactgtatttccggcagtgaaagcggttggagaagaactgggtgagaagattttttatctgacggcaaagacaatcacccggacggtggcggagcaggcattcgaaaccttacgggaacagaatctgaagttcaaggtgatcactttaacggcaaaagaaaaaatctgtttctgtgaggagacaagctgtaatccggatgactgcccatatgccaaagggcattttgaccgggtaaatgacgcggtctatgagcttttgctgcaggaagatgtgatgagccgggaagtgttggaagcgcaggcaagaaagcataaggtctgcccatttgaaatggcactggatgtgtcgacctgggtggatggtgtgatctgcgattataattatgtgtttgacccggatgcccggctcaggcgtttctttgcagaaggtggcgctggaggatatttgtttctgatcgatgaggcacacaatctggtagaacgtggacggcagatgtacagtgcagagttatgcaaggaggactttcttgcggtgaagaaactggtaaagggagaagcaccgcggtttgcaaaaagactggaggcatgcaataagattcttctggcaatgaaaaaagagtgtgaaaactataaggtgctggacaatatttcgcattttggaatccagcttatgaatgtactatctgagacagaccggtatctcgaggaatgtgtggataaagaagtccgggaaaccgtattagatttttattttcaagtgaggtctttcctgaatatatatgatgggttggatgagaactatgtcgtctatacggagtataaggagaatggaagatttgttctgaagttgttttgtgttaacccggcggcaaatctgcagaaatgtctggataaggggaacagtgctgtattcttttcggcaacacttctgccaatccagtattacaaaagacttctgagtacggaaaaagacaactatgcggtctacattgattcttcgtttgatacaaagaagagactgcttatgaatggtgtggatgtgagtacccgttacaccatgcgttccagggaaatgtatcaacgatatgcgacatacattttccgggtagtgaaagcaaaaatggggaattatctgatctttttcccgtcgtatcggtttatggaagatgtgtatcaggaatttacacagcttcttgcatcagatggagaagagatggaactggttattcagcagaagcacatggatgaagaagaacgggaaaatttcctgcgtgcatttgaaatgggaagagagaaaagtctgatcggttttggagttcttggcgggattttctcagaaggaatcgatctgacaaatgagaagctgatcgggacactgatcatcggaacagggctgccgcaggtgtgcaatgagcgggaaatcctgaaaagctattttgaccagaagggactttacgggtttgactatgcttaccggtatccggggatgaacaaggttttgcaggcggcaggaagggtgatccgaacagaggatgaccgcggagtgatacttcttctggatgagcgttttcagagggagaaggggaaagagattttcccgaaagaatgggcggactgtgaaagatgccggttagacattgtggaagaaaaaatccgtctgttctgggaaaaacagacggataattaagaaactttttatgcattaaagtaatccagaaatgcctgtgtcgcgcgtgaaaccggaacatgtccgttccatgcggcaaccagctgacgctttggaagttgttcttcggtctggacgacaaagagctggtcggaattctttggtacacagtagtccggaataaaagcgatgccaagtccgatccgtgcgagatcgatcagaagatcgttgctgctcagctcgatttcaggaaccagatccaactgatgctgctggaagagagaatgcagaaattcactggttgtactttttctgtccagcatgatgatcggataacgctgcagttctttgagggaaagctttttcccctgcagttccgcaaaggactggtttgcgataaagacatcgtgaaaatcacggatctttcggaaggaggcaagactgccaaggtaaacgttcggatagttagcgacaatgagatctacctgaccgttctcaagaagttccgtacacttgatcgaagtggcattggtcacttttatatgtgcgttagggaaagctttgtggaaacgttccagataagggaccagaaaataccggcagatggtgtcgctggcaccgatgcggatctgaccgccggtagaggctgtttccatgatctgggattccccgcgcttgatcagattgatcgccggttcgatatgacgcagaaggatctcgccttccggggtgagctgaactttttttgtgcttcggatgaaaagaacctgatccagtttcttttccagtgctttaatggactggctgacagcggactgtgaaataaagagctgcttggaagcctcagaaaagctgagtgtgtctgcaacataataaaatactttatataattcatagttgatatccattattagtcctccttataaaacctattagtattataagtgataaaaaataaaatttcaagagaaaaccatttttgacaaatgaagacagggttgctaaactatagacaaaaaagagaaggagaaaaaggatggcaaaaaagaaatggctgcataaaatcctggcgattttgccgagtatttcactgatcgtgatcctgctgatcagcagttttgagatcggtgcatacggagactggaatttttatgaaaaagaatatgaaaaatataaggtagcggatgaactttatatggagatgccggatattatgaaggtgacaaaattcatgatgtcttatttgcggggcaacgagaagaaactgagtatcgagacggaagtggaaggaaatatacaggattttttcaatgagaaggaccggcttcatatggcagatgtgcagggactttttcttggcggacttgcaatccggaggggagcgatcatcgtactgcttttttcaatggcggcacttgtgcttatgaaagcagactggaagagactgatcccgcagatgtatcagcgggtgctggcggtatttctggcacttaccgcggtgtcaggatttctgttctcaagagactttaacaaatatttcgtgatctttcatcatattttctttaacaataacttatggatccttgatccggcagaagactatatgatccggatgcttccggagggctttttctatgatatggtgatgaggatcggaagtatttttgctgtgtttttaatcgtatcttttgtctgcagtattgtccagaaaaagataaataagagatgcggttcacggtaattgtaataaataagatatacttataaaaagatttagttatatttattgtacttataaaaggtgatgtggtaaaataaaaatcgaggaaactgccgttatgccggatcaaggcatgcggtttcaatattactaccaaagctaatggaggaaattatgggcgtaaaacgtgtatatgtggagaaaaaaccagaatttgcagtacaggctaaagaacttcgccatgaggtgaagagttatcttggaattaagacggtgaagaatgtacgtgtactgatccgctatgatgtggaaaatctttctgatgcaacatttgaaagagcatgcaacggtgtgtttgcagaaccaccggtagatgtgctttacagagaggacttcccgcgcgaagaaagtgatcacattttttctgtagaatttcttcctggacagtttgaccagagagcagattctgctgttcagtgcgtacagtttatcaaagaggatgagctgccggttatcaagacagcgaccacttatgtgatcgaaggtgagatcagcgaagaagagatggaagctatcaaggcgcactgcattaacccggtggattccagagagacaggacttgaaaaaccggagacactggttacaaaattcgaggaacctgcagatgtaaagatttttgacggattcaaagatatgccggaagcggaactgaaagagttatacagttctcttggacttgctatgacattcaaggatttccagcacatccagaattatttcaaaggggaggaacacagagatccatctatgacagagatccgtgttctggatacttactggtctgaccactgccgtcatactacattctcaacagaacttacagaagtatccttcggtgatggcgattacagaaagccgatggaagatacttataaagaataccttcagacacacagtgagatctttaaaggacgcgaagacaaatttgtatgcctgatggatcttgcactgatggcaatgcggaagctgaaaaaagaaggcaaacttcaggatcaggaagaatccgatgagatcaatgcctgcagtatcgttgtcccggttgaagtagatggtgtggaagaagagtggcttgtcaacttcaagaacgagacgcacaaccatccgaccgagatcgaaccatttggtggtgcagctacctgccttggtggagcaatccgtgacccgctgtcaggacgtacttatgtataccaggcaatgcgtgtaaccggcgcagcagatccgaccgtatctgtaaaagagacgatgaaaggaaaactgccgcagaagaaactggtgcgtagtgcagcacatggatacagctcatatggtaatcagatcggacttgcaaccggactggtaaaagagatctatcatccggattatgtggcaaagagaatggagatcggtgcggttatgggtgctgctccgagacgtgcagttatccgtgaaaattcggatccgggagatatcatcattcttcttggcggacgtaccggacgtgatggctgtggtggagcaaccggttcttccaaagttcataccgaagaatccatcgagacatgtggagctgaggttcagaagggtaatgcgccgaccgaacgtaaaatccagagaatgttccgcagagaagaagtcagcaagctgatcaagaagtgtaatgacttcggagcaggcggagtatctgttgcaatcggagaacttgcagatggtcttcagatcaatctggacaaagtaccgaaaaaatatgcaggtcttgacggaacagagattgcaatttctgaatcccaggagcgtatggctgttgtggtagatccgaaggatgtagatgaattccttggctatgcaaaagaagagaatctggaggcggtaaaggttgcagttgttaccgaagatccgagacttgttctttcatggagaggaaaagagattgtaaatatttcccgtgccttcctgaacaccaacggtgcacaccaggagacaacggttaaagttgatattccttcaagagaagataccatccttaagaaacaggttgaggttggagatgtaaaagaaaaatggctggatactctgaaagatctgaatgtatgctcgcagaaaggtctggttgagatgttcgacggatccatcggagcaggctcagttttcatgcctcacggcggaaaataccagatgacagagacgcagagtatggttgcaaagcttccggttatgcatggtaaatgcgataccgttacgatgatgagttatggatttgatccgtatctgtcaagctggagtccgtatcacggagctgtctatgctgtcacagagtctatggctaagattgtggcttgtggtggggattacagcaagatccgttttacattccaggaatatttccgcagaatgacagaggatccggaaagatggagtcagccatttgcagcactgcttggtgcatataaggcacagattgcttacggacttccgtcaatcggaggaaaggacagcatgtccggaacatttgaacatatcgatgtaccgccgacactggtatcctttgcagttgacattgctaaagaaggagatatcattactccggaactgaaaaaagcaggtaataaacttgtatggatgaagattgaaaaagatgaatatgagcttccggtatatgaacaggtaatggatcagtacggtaagttcgctgatgatatccacaacggaaagatcgtatcggcttacgcacttgaccgccatggagtgatcgcagctgtcagtaagatggcattcggtaacggaatgggtgtgaagatcgaacacagcatggatgcaagagaactttttgcacctgcattcggtgacatcgtagcagaagttccggcagacaaggttggagaactctccatttcttacactgtgattggtgaagtgacagatgatgcgaaattcgcatttggagatacagaaatcacactgaaagaagcagaagatgcatggacagaaactctggaacaggtattccgtacggtatctgacgaagcttctgacgaaaaggtagaatctccgctgtatgatacaaaagacattgtaatctgtggacacaagattgcacagccgactgtatttatcccggtattcccgggaacaaactgcgagtatgacagtgcaaaagcatttgaaagagcaggtgcaaaggtcatcacaaaagtattccgtaacatggatgcagcagatatcgtagattctgtgaatacatttgaaaaagaaattgcaaaatcccagatcatcatgttcccgggtggattctcagctggtgacgaaccagatggttcagcaaaattctttgcaactgcattccagaatgcaaaactcaaagaagcagtagaaaaacttctgaacgaaagagatggtcttgtacttggtatctgtaacggattccagacactggttaaacttggtctggttccttacggagaagttgtgggacagacaccggattctccgacactgacctacaataccatcggacgccatatttccaagatggtttacacgaaagttgttaccaacaagtcaccatggctgcagggggcagaacttggcggagtttacaccaatccggcatcccacggagagggacgttttgttgcaagtgaagaatggctcgacaagctctttgcaaacggacaggttgcaacacagtactgtgaccttgacggaaatgtatctatggacgaagaatggaacgtcaatggctcttatcgcgcaattgaaggtattacaagtccggatggccgtgtgcttggtaagatggcacattcagaacgtcgtgcagattccgtggcaatcaatatttatggtgagcaggatatgaagatctttgaatccggtgtgaaatatttcaaataagacgggaaatctggaataaaatgcttcgaatgagacgaaaatgcaagattgtcgaaacgaacttgcaaaaaagagaagaagtatcaagaaaaaaaatgaaaatcagctgtatttgaaacaaaaatgtagtggaaattcataaaaattgaaaaatatgaaaaaaaatcttgacacaggcgcctgaatgctttactctgttaaagaacaaaggtgttccggagggacagacatttgtttgtccctctttttttagcaaagaagtgtgcaaagttacatttttgtaaaagaacattcaggaggtattgagtagtatgtcttatgttgatgaagtaattgaacttgtagtaaagaaaaacccagatgaaccagaatttcatcaggcagtaaaagaggttctggaatctcttcgtgcagttgtagaagctcatgaagaagaatacagaagagacgctcttcttgaaagactcgttgagccggaaagacagatcaaattccgcgtaccgtgggtagatgataaaggtcaggttcaggttaatacaggataccgtgtacagtttaacagtgcaattggaccatataaaggaggattgcgtcttcatccttcagtaaatatcggaattatcaaattccttggattcgaacagatcttcaaaaactctctgacaggtcttccgatcggtggaggtaaaggtggatcagatttcgatccgaaaggaaaatcagatcgtgaagttatggcattctgccagagctttatgacagagctttgcaaatatatcggagcagacacagatgtaccggccggagatatcggaacaggtgcaagagagatcggatatatgtacggacagtacaagagaatccgtggattatcagaaggtgttcttacaggtaaaggactcagctacggtggatcccttgcacgtacagaagctacaggatacggacttctgtattttacacgcgaaatgctcaaacttgcaggaaaagacatcgctggcaagacagttgctgtttccggagccggtaacgttgctatttacgcaattgaaaaagcacagcagatgggtgcaaaagttgtaacatgcagcgactctacaggatgggtttatgatccggaaggaatcgatgttgcagcactgaaagaaatcaaagaagtgaagagagcaagacttacagaatacaagaactaccgtccaaattcagaatatcatgaaggacgcggtgtatggtcagtaaaagttgatatcgctcttccttgtgcaacacagaacgaacttcatctggaagatgcaaaacagcttgttgcaaacggatgcttcgcagtagcagaaggagctaacatgcctaccacactggaagctacacagtatctgcaggagaacggtgtattatttgcacctggtaaagcttctaatgcaggtggtgttgccacatcagcacttgagatgtcacagaacagcgaacgtctcagctggacattcgaagaagttgatgcaaaacttcagaacatcatggtaaatatctgccacaacgcagcagacgcagcaaaacgttatggagcagaaggaaactatgtagtaggtgctaacattgccggatttgaaaaagttgtagacgcaatgcaggctcagggaattgtataagacatatcctctatgtaaaatataatcagaaagatcttcggagtaatccggagatctttctgatttatgcgaaaatgttgaatgatataggttgtgtgggcggtcgctggaaaaagaatccaaacgattcttttccagtacttgtctgttcaatggtatcgaatgaaaaatggtaaaaataaaacaaaaaaatgaaaaaaatagttgacatttagaagtagataattgtataataacgaagtcggttgtaaaacggacgaacatatgggatcatagctcagctgggagagcatctgccttacaagcagagggccataggttcgagccctattggtcccatttcgcgagaaagttttttaaagtcgaaaacattgaacgcgaaatgtgacgagcacttcgtgtgatgcacacagctctgaagagctggcacaaaaacatatcatatggcgggatagctcagttggctagagcacgcggttcatacccgcggtgtcgctggttcaaatccagttcccgctactacaagaaggagtccttgtgtggggcttctttttgcgttatatctatattatcattcatgaaaacgctgaatatcatttgccatattccaacttttatactcaaactataaaattcacaaatattaaactacaagcgatccattgctttaaaatttcccaacaaagtacccctccaatacaaaagccattgataaatccccaattgcataggtgcttaaactcaacatttcccaggcagtcgcttccaagcgctgccgtcttttcagagaaagtcagcaggaggagaaaaatatcccaccagattccatgtttgtccaatggagataagactcaaaaattgtggaagccattgctgacacaattttcgctctcagaggcttatcggaatggtttggacaaaggaatccggtgggatattttttctccttttgcgtcccctctgaacccgctccatttcgtctgtctcccaacaaaacctatgcaatccccccaagatgtgataaaatatccctagattacgacaaaacggaggaattttcatatgacatctaagacaaagcagatcatcatggctgcaatcggcgcatatctggtatataccggcatatcacttgtgaaggacacaattgtcggagaaccgaaaaaccagatcctttttattctggtcggagtattttttgcactgtttggactggctacgattatctggaatataagaacaatcgtaaaagagacaaaggcagaaattcagggtacaactgcaggggcagaagaaaacgaagatggcgaagaagcggcaaaaaaggtttcttcagggaaaggagttgcagacgttcatgtaggagctgatacaaaagaagagaagtctgcggataaagaggaaaggaaagaaacagctgctgaagaaaaaacggaagatggtgaaaaagagaaaaagaaagcagaagatgatacagaagcggtaaaagacgaagaaaagaaaactgtggaggacaaagaagataagaaagcagaagaggtgccggaagaaaagagcgacaaaaaagcagatgccagacaggaaggagaagtgtagaagatgcgtgttggaatgggatatgatgttcataaactgacagaaggaagaaagctgattcttggtggggtggagatcccatacgaaaaggggcttcttggacattcggatgcagacgtacttttgcatgcgatcatggatgccctgcttggggcggcatcacttggagatatcggaaagcattttccggatacagatcctgcatacaaaggaatttccagtattaagcttctggagcatgtaggaaagctgctggatgatcgtatgtatgtaattgagaatattgatgcgacgatcattgcgcagagaccgaagatgcgcccacatatcgagcagatgaaaaagaatattgcagaagcactgcatattgaaacgaatcaggtaaatgtcaaggcaacgacggaagaaggtcttggatttaccggaagtggggaaggaatttcttcccaggcaatctgtgcaatcgaaaaactgactaatttcagcagtgtagacgtagcagcacctgcaggtggctgcgcaggctgtggaggttgtgcagcaagacagatgtagatcaagtctgaatagaaaggcacggcgaaaaagtaaaatgaagatactgaaaaaactgaagccggaagaacgtgggcttacaagaacactgtgggaacaggtatttacagaagatacgaaagaatttctggactattattacacagaaaagacgaagaataacgaaatctatgtgatcgagacagatcacgatatccgggcgatgatgcagctgaatccttatgtaatacagatggggaaaaaggcagtagagagcagatacattgttgcagttgcaacagagcctctttatcggcacagaggttatatggcagaattattaagcaagacagcaagagatctgtatcagcaaaaaatgccattctttttcctgatgcccgcaagtgagaaaatttactatccacataattaccggtttatctatgcagccgatgtgtggagtgcaaaaggaacagacgggaaagaactgacaatacagaagatcgtggaattgcagaacgattccggcgtgagactcagaaaggcagaggaaaaagactgtaaaaagctgggagattttgcggaagaagttctggaaaaacagaaaatacaggtatataccaaacgggatgcagtttattatatgcgccttttgaaggaacaggaaagtgaaaaaggcggaatcctgatcgcagagcaggatggagagatgcgaggaattcttgtttttgatgaagaagatgggcttgcagtaagagagccattgatccgaaagggatatgaagatgtttttgataaggcaggagtcatcctcaaaaaagaagaaaagaaaaaaccgttgatcatggcacggcttttgaatgtagaaagtcttctgtcttcaatggtgtgcaaagaagagatggatctggagtttgttctgtatgatccgattatccgggaaaataactgtctgtttatgctaaaaggcaatgaagaacatcttgtagtccggacaaggacagcacacaccggcaaagatgatgctgtgcagaagatcagtattgatgcgcttacatcgattgtatttggctataaagagctggaaaagattgaagaggaagaaaaagagatcttttcagcagaattcaaagaagaaatcagtaaattgatgccgttttctcctgtttttatcaacgagattgtctgataagcgggttgacaaaataagaaaaatcgcatactatatgtactagatatgaataaaactgaaaagacggagaacgaaaagagtagttatcctcagagttccatcagagaggatctgtcatcggctgaaagcagatccgggagcagggatgatgaagtgcattcgggagttgaccgggcgaacgtgaaagtgaagattttacaagtagccgggtacgtgtggcagacgttacaggccgtgagagaaaagcaggagagctgcttttaatttagagtggaaccgcggaaacttcgtctctttttgagacggagtttttttatttcacaggaaattccaaatcagaggtgaatgaaatgggagttatttcctatatcaaagaagaaatcaaagtagtaaaagaacgagatccggctatcaaatcggatatagaagtacttctgtatccaagctttaaggtaatgcttcattacaggatcgcacataagctgtatctgaaaaaacactattttctggcacggtgggtgtcacagcgtggtgttagaaagacaggaattgagatccatccgggagcaaccattggaaaggggctttttatcgaccatggaagtggcgttatcatcggcgagactgcaatcctgggtgataatattacactgtatcagggagtaaccctgggtggtacaggaaaagagcagggtaagcgccatccaacgctggaagacaatgttatggtcagtgccggtgcgaaggtcatcggttcctttacaattggaaagaattccaagatcggagcaggatctgttgttatagaggaagtacctccgaactgtaccgttgtcggtgtcccgggaagaattgtccgcatgggtgaccagaaagttccgagtgctgacctggatcagatccatctgccagatccggtattgaatgatatccgtcagcttcagactgacaatatccgtctgaagaaggaactgaaagcattgaaagaaaaacttgcgaaagaaaaaataatcgaggaagcatagaaaaaagaaggagcagatttatgaaagtatttaacacacttacgaaaaagaaagaagaattcgtttctctggaagaaggaaaggtaagaatgtatgtctgcggaccgaccgtatacaattacatccatatcggtaatgcaagaccgatgatcgtatttgataccgtccgtcgttattttgaatacaaaggatacgatgtcaattatgtatcgaacttcacagatgtggatgacaagatcatcaaaaaggcaattgaagaacaggtatccgcgcaggaaatttcacagcgctatattgcagagtgcaaaaaagatatggcaggaatgaatgtaaagcctgcaaccaagcatccacttgctacagaggagatctgcggtatggtagagatgatctctgaactgatcgacaagggttatgcttatgaaaagaacggaaccgtttatttcagcacaagaaaattcaaagactatggaaaattatcccacaagaatctggatgatctccgttccggtgggcgttctcttctggtaagcggtgaggatgaaaaagaagatccgctggatttcgtactctggaagccgaaaaaagaaggagaacctttctggaagtcaccttggtcagatggacgtccgggatggcatattgagtgttctgtgatgtcgaggaaatatcttggtgaacagattgatatccatgcaggtggagaagatctgatattcccacatcatgaaaatgaaatcgcacagagtgaagccgctaacggtaaagaatttgcaagatactggatgcacaatgcattcctgaacattgacaaccgcaagatgtcaaaatcactcggaaacttccgtacggtaagagagatcagcgagcaatatgacctccaggtgcttcgttttttcatgctgagcgcacattacagaagcccgctgaacttcagtgcagagctgatggaagcatccaagaacggtctggagagaattctcaatgcaaccgataatctgaaacatcttatcgcttcagtggcagcagaagagatgagtgccgaagaaaaagaagcattttcaaaaactgatgcatatgtagaagaatttgaaaaagcaatggatgatgatttcaatacagcagacgcaatcgcagcaatctttgaacttgtaaaatatgcaaataccactgcgacagcagaaagctcaaaggaatatctccggggattactggacagaatcgtaaaactcggtgatgtcctgggactgatcctggataagaaggaagaacttctggatgcagatattgagaaactgatcgaagagcgtcaggcagcaagaaaagcaaaagattttgcaagagccgatgcgatccgtgacgagcttctggaaaagggaattatcctgaaggataccagagaaggagtacaatggaaaaaagcgtagaatttgaaattgctgactatataaaagaagtgcttgagatgaaagaggtggagccggaaggctattcacctcttaccctggcttatataggggacagcatttatgatctgatcatcaagacaaaggtgatcagcgaaggcaataaacaggtaaaaaaattacatcaggagacaagcagtatggtgcaggcgtctgcccagtcagagatgatgcgtgcccttcagccattgcttactgaagaagagcatgctgtttacagaagaggacgaaatgctaaatcagtatcgccggcaaagaaccagtcactgaccgattaccgacgtgcaaccggatttgaagcgttgatgggatggctttacctgaaaagagaatggaaaagaatggcagatctgatcaagatcggtctggatcacttaagcgaatgcgaagaagaaaagaagcaggagaaatagaatggaagaaaaaaagatgaacagtcagcagatcgagggaagaaatgcagtaatggaagcatttcgctccgggaaaccgattgacaaagtatatattcttgacggatgtcaggacggaccgatcagaagtatcgtaagagaagcaaaaaagcatgatacgatcctgaattttgtaaccaaagaacgtctgaaccagatttcagagaccggaagacatcagggggtcattgcacaggcagcggcttacgagtatgcgcaggtggaagacatgctggagcttgcaaaacagaaaggggaagatcctttcctgatccttctggacaatattgaggatccacataatctcggcgcgatcatccgtactgccaatcttgcaggtgcgcatggtgtgatcattccgaagcaccgcgcagcaggtcttactgcaaccgttgcaaagacatcagcaggtgcgctgaattacacaccggtagcaaaagtcaccaatctggtgaaaaccatggaagaactgaaagaaaagggactctggttcgtctgtgcagatatggatggggatgtgatgtaccgcgtgaatctgaaaggaccgattggtctggtgatcggaaacgaaggcgaaggtgttggacgtctggtaaaagaaacctgtgatatgacggcagccattccgatgaagggagatattgactccctgaatgcgtctgtggcagcaggtgtccttgcctatgagatcgtgcgtcagcgcatgagttaggaaaatcggagaatgaaaatggatctggggaaaatgacggatgagcagctgattgaactgcttcgggaaggtaagaccgagatcacggattatctgatggaaaaatacaaagacatggtacgcaaacaagcgcgtgccatgtatctgtggggcggagaaaatgacgatctgatccaggagggaatgatcggtctttttaaagcggtgcaggattatgatccgaaagaaggtgcaagcttttcaagttttgctggactttgtgtgtcacgccagatgtatacggcgattaaggcttcacagcggaaaaaacatctgccgctcaattcctatgtgtcgatttacgcatctgccagtgacaatccggaggagaacgggctttccatagtagatacgatcgaagcagggaaagagagtaatccggagctgatgattcttggagaagagtatacgaatgcatttgaagaggaactgaaagaaaaattaagtaagctggagcgaaaggtgctgtatcttcatttgcagggaatggaatatctgaagattgcagaatttatggacaaaagtccgaagacgatcgacaatgccctgcagcggatcaaagcgaaagcacgccagcttctggaagaaaaacgccggtctgaaaaaaagtaaaaataaaaatttaaaaatattgacaagcaaagcagtgatgtgctatattaaatgagtcgcgaaaatgcgcaggctgccttggctcagtcggtagagcgtcgccttggtaaggcggaggtcggcggttcgattccgctaggcagcttatttatttaagaagcagagttgtatttccggttggagattacgatgtctgctttttttgtacttgttcatgtatagaaagtgtgataaactaaagaacatgaatcaaaactgtccacaggacaatgattgagatgcatgacaagaaaaagactgccatataatggcagattatgaagtaatagagagatgcgaggaggaacttcaatggcagaagaagctgtatcaaagaattttatagaacaggaaattgaaaaagatcttgcagaaggcgtatacgatcatgtatgtacccgttttccaccggaaccgaatggataccttcacatcggacatgcaaagtctatccttttaaactacggacttgcacagaaatataacggaacattccatatgcgttttgacgataccaacccgacaaaggaaaagacagagttcgtagaatccatcaaagccgacatcaaatggctgggtgctgactggggagatcacctttactttgcatctgattattttgatcagatgtatgagtatgcaatcaaactgatcaagaaaggaaaagcttatgtctgtgacctgacagcggatcagatccgtgagtacagaggaactctgacagagccgggaaaggacagcccgtaccgtgacagaagtgtggaagagaacctggagctttttgaaaatatgcgtgcaggcaagtatgcagacggagagaaggttctccgtgcgaagatagatatggcatcaccgaatatcaatatgagagatccgatcctctaccgtgtagcccgtatgacacatcataataccggtgataagtggtgcatctacccgatgtatgactttgcacatccgatcgaggatgcaatcgaaggaatcactcattctatctgtacactggaatttgaagatcacagaccgctttatgactgggtagtaagagaatgtgaatttgcaaatccaccgcgtcagatcgaatttgcaaaattatacctgacgaacgtagttacaggaaagcgttacatcaagaaacttgtagaagataagatcgtagacggatgggatgatccgagactggtttctatcgcagcacttcggcgccgtggattcacaccggaatctatcaagatgttcgttgacctgtgtggagtttccaaagcacagagctctgtagattatgcaatgctcgagtactgcatccgtgaggatctgaagcttaagagagcacgtatgatggcagttcttgatccgatcaagcttgtgatcgataactatccggaaggacagattgaatatctggatgcaccgaataatcttgagaatgaagaacttggaagccgtcagcttccatttggaagagagctttatattgagagagaagactttatggaagagcctccgaagaaatatttccgtctgttcccaggcaacgaagtacgtctgatgaatgcttactttgtaacttgtacaggatttgaaaaggatgaagatggtaatgtaactgttgtacattgtacttatgatccggagacaaagagcggttccggattcacaggaagaaaagtaaaaggaacgatccactgggtagaggcaagtacagcacttccggcaaccgtaagactgtatgagaatctgatcgacgaagaaaagggtgtctacaataaagaagacggttccctgaacctgaatccgaattctcttacagagaaagaaatctttgtagaatcaaactttgcagatgcaaaagcatatgaaagcttccagtttgtacgtcagggatatttctgcgtggattctcatgattcgtctaaagaacatctggtatttaacagaatcgtttcgctgaagagttcgtttagacttccaaaataacggaatggtaataaaagacccggtaagaaaaataaattttcttccgggttttgttttatgcagaaaatgataatctgcaagaaaagtgcttttttaaatttcttcagaagcaggggcggattcttcggaatcatcttcctgcgtctgggaagctgctttttctgattcggtttctgcatctttatttttttctacaggctcttcagaagcttcttcttttgcagatgttggcgtaagagttgtgtaaccacgctcaggcacttcgccaagatcatcatccagttcaaaatcatcctcttcaaaagagtcatcgaactcgtcttccggttcttcattatgtcggttctttaaccagtaatatgcaccggcaccagctgcgcctgcggcagtcagtccgagcaggattttaccaaaatttttagccatgttgctgctcctttcttgatctcgtcctgtcagatatggcagatgagatagttcgtcatgaaatatagtatacatgaataattttattgtaatacttttatttgaaaagggaaagtaaaatatttataaaagaaccagaaaaacaacaaaaataaggaagtgttgtacgattataagcagcgggaatgttgtgaaagaataaaaattgtgttacgatatacaatagtatctaaagagaggaagaccgcgcatgagagaaattacaaaataccatgataccagtaagacagtcaaagaacgtgccaagaacaaattatttggtgcagtgtacagccatactgcaattattcttttactaatccttcttcagattggtattatggtcctcacttttacatatctgggaaattacagtacatatatgaacggagtgatgtcccttctctcctttattacagcgatttatatttttaatgaaaaagggaatccggcgtttaagatgacgtggatcctgtttgtgttccttgtcccggtggttggagttggattttatctgtttacaaaagcagggatcggaaccaaatatctgggtgccagactggagaagcttcgagtggagactgaaccttatatgcagcagaatgaatatgtcgtccatgcgatgaaaggtggaagggttgcgaatgccaatctgtcacattttctttataaccaggtgggatttccgacttatgggaactcacaggcacagtattttccactgggagatgacaaatttccgattctgatcgaggaattgaataaggcagaaaaatttattttcatggaatattttattatcggagaaggatatgtgtgggacactgtcctggaggtcctgcgtaaaaaggtgaaagagggcgtggaagtacgcctgatgtatgacggaacctgcagtatcagccttttgccgtatgagtatccgaagcagctcagggaatatggaatccagtgcaaggaatttggaccgatcgtacccatcctttctaccagccagaataaccgggatcaccggaaaatctgtgtggttgacggaaaggttgcatttaccggaggtgtcaatctggcagatgaatatatcaacaagaaagtccggttcggacactggaaagatacagcgatcaaaatcgaaggcgatgccgtgcagagttttaccatgatgttcctgcagatgtggaatattacggagagacagccggaggattatgcaaagtatctgacagaaaagcagccggggttcagccgcaaagacggttacatcatcccatatggagacagtccgtttgaccatgagaatgtaggagaagaagtgtatttccacatcctgaatcatgccaagaagtatgtgcatattatgacaccgtatctgatcctggacaatgagatgattgatgcgctgacaagagctgcaaaaggtggaatagaagtgcagattattatgccacatattccggataagccgtatgcattttatcttgcgaagacttattatgaggaactgatcgcaggcggggtagagatctatgaatatacgcctggatttgtccatgcgaaagtatttacttcagacgatgatacggcgacagtaggcagtatcaatctggattaccgtagtctttatctgcattttgaatgcggtgttttcatttaccgcaatccggtggtgcgtgatattgaaaaagatttccaggagacccttgcaaaatgccagaaggtgacgatgacggaggtcagaaaccggagcacttttgtgaaaatatatggtcaggttttaagaattgtggcaccgctgatgtaggaaaacactcagagagcagtaaaatcaagaaaaatgcggaattttcgggaagtagctgaaaataagagtgtactttttatttgaaatgtagtataattcaatcggtgtctttataagggacattgattatatttataagtaggagttatcccgatgaaaagagggatgacactgtggagatatttcacagatagccaagaacacgcaggaggatttattatggttaaagcagtagtaggtgcgaactggggagacgaaggaaaaggtaagatcacagatatgcttgccgaaaaagcagatattatcattcgtttccagggtggagcaaatgccggacatacaattatcaatgattacggcaaattcgctcttcatacattaccgtcaggagttttctacggacatacaaccagtatcatcggcaatggtgtcgctgtagatatcccggttcttttcaaggaaatccagtcaatcattgacagagatgttccgatgccgaagattctggtgtcagaccgtgcacagatggtgatgtcttatcacaagaattttgatgcatatgaggaagagagactgggcggaaagtcgttcggatctacaaagtctggtattgcaccgttctattcagacaagtatgcaaagatcggtttccagatcagcgagctttttgaagacgaagctgaacttagagaaaaggtaaatcgtgtagcagagcagaagaatgttatgctggaacacctttatcacaaaccgttaatcaatcctgatgatttatataacgaactgatggaatacaaagaaatggtagcaccgtatgtatgtaacgtttctctgtatcttgacgaagccctcaaggaaggaaaagaaatccttcttgaaggacagcttggaacattaaaggatccggatcatggaatttacccaatggtaacttcttcttctacactggcagcttatggtgcgatcggtgctggaatcccgccgtatgagatcaaacagatcgttacagtatgtaaagcatactcaagtgcagtaggagcaggtgcctttgtaagtgagatttttggcgaagaagcagatgaacttagaagacgcggtggagacggcggggaattcggcgcaacaaccggtcgcccgagacgtatgggatggtttgactgtgtagcatccaaatatggatgccgtatgcagggagctacagatgtagcatttactgttgttgatgtacttggatacctggatgaaattccggtatgtgtaggatacgagattgacggagaagttacaacagaattcccgacaacacatcttcttgagaaagcaaaaccagtattcaagacacttccgggatggaaatgcgacatcagaggaatcaagaaatacgaagatcttccggagaactgcagaaactacattgagtttatcgaaaaagaaatcggatatccgatcacaatggtttctaatggaccgggaagacatgatatcatcttcagaaataaataggaatataaaaaaggggcagggcttttttaagtcctgcctcatttttatggtaaattatcaaattgtgataatggttggttatgtattacagtaagtacactccgcgggatgcagcttcttcgaggacgtcgtccggccagatggaggactggacttctccgatgtgggctttgcggagatagaacatacagattcgggactgtccgattccgcctccgactgtgtacggaagttttccgttcagtaatgctttctggaaatccatctcggcgcgttcttcgcagccggcttcctttaactgacggcggagtgcatcttcatcgacacggatacccatggaagaaagctccagtgcgatatcgagtaccggatagtagacgatgatatcaccgttcagttcccagtcatcgtagtccggtgcacgtccgtcatgacgctgtccggaggcaagggtcttaccgatctgtttgatgaatacggcacctttggctttggcaaagtggtattcacgttcctttggtgtcttgtccggatacatggtttccagttcctgggatgtgatgaagctgatttcatccggaaggaattcttcaatataattgtaacggcgtgccatgtaggcttcggtttctttgagtgcactgtatacttttcctacagtgtattccagtgtctccatgttgcgttcttctttggaaattactttttcccagtcccactggtcaacatagatggaatggatgttgtcagtatcttcatctcggcggatagcgctcatatcagtataaagtccttctcctgaatgaaagtcgtagcgctttaaggcgtaacgtttccattttgcaagagagtggacgatctcaacttcgcggtcttcctgttctttgatgccaaatgcaaccgggcgttctactccgttcaggttatcgttcagtccggattccgggcggacgaaaagaggagcggatacacgcgtcagatgcagagatttggcaagtgcgcgttcaaagtggtcttttacttctttgattgccacttcagtctcgcggatcgtaagtggagaatggtaattctccggtatctgcaaattgttcatgatgttcttcctttcttactactcactatgtctagtttagtgaattgacgtggtgttgtcaatcatattttcttaagaaacaacttatgatttttttagagaatctccatagtaaggtcacagaacacggctatactcttaaaataaaacattcatcataaaaaagaaaaagtcataaatcagaaaataagaacatatattaaagatgtcggggaaatgccggatgaggcttataccagaaggcagacagacgaaaaaactgtagacaggaggtaacaagatatgcagaaagagaagaatatcagcacacaggaagtcatttccatggaagaatatttaaataagagacagaagatcagagaacaggagaaaaaacgattcggtggcagattcggcgaagagaaaagccctgcctggatgatggcagagctttatgtatgagatgttaatattcactgtgaaagtcgtcatcattcctgtggatcagacgataaaccaggatgtaggcgtaactcataaccggcacaagaatcgtgcaggcaacagatgctttcagaagtcctaatgatctggatttgtcgataaatgcaaataccagagtgctgacgtacatcaggaacagaagaattgcacagataagagccgcaaaacgcttgatttttttcataacaaccaccttcgtactgtactttatctctattatatagataaaaaacaatttctacaagaaaatgttttgcaaacagtcgaaaaatgctgtatgatatatgaagtgataaagaacaaaaaggagaatttacagtatgagtacattattagaacagtggagagataccgcttactcgaaagagatggataaagcttctctgcagaagttctggggaacctatttccagactgaaaaagagatctatgaaaagctgcttgagaatccggacgaagaagtaaaaggaactgtaaaggaacttgctgaaaaatatggcattaatgtatttacaatgacaggattccttgatggaatcaatgacagcctgaaagtggctaatccaattgaaacaatggatgaggacactgaggtaagtcttgcttttgataaagaactgctttacaagaacatggtagatgcaaaagctgactggctgtatgaactgccacagtgggataagatttttacagaagaaaagaaaaaagtcctttacaaagaacagaaaaacgcacgtacaatccacgtagaaaagaaagtttatccaaacgatccatgtccgtgcggaagcggtaaaaaatataaaaaatgctgtggtaagaacaaataagttctgatagaaattttcaatacatttttttgaacgtgttgacaaatgaaaatcccatggtataatgttagcaaatgcgatgaagagaagagtagaacgcagaaaaatcccagagagagaggtcttaggctgagagcctcttattacagaagcgtttgaagaccacctccgagcggctgtaaaacagtccggctggataccgttatcatccacaaagaggtcctggaaatcaggacaagcggggtggaaccgcgggtatacaaagtgactcgtcctctgcagcagataatctgttgcagaggttttttattttaaaagttaagttgtctggaaaagatgtactagaaaatttgaaggagcatattgcacaaaagaaattcagccaattcactttttgcgcaatggagatgaaactcaaaaatcgtggaagccattgctgaacacgattttcgttctaagaggttcatcggaatgcccttgcgcaatggaattggatgaaattcttttgtgcaatatgcggtcttgaattacagacagtagcttttacagaaaggatgatctaatggaaagtatttacgattgtttcaagctgaacaatgatatgaaaatcccatgcgttggttttggaacttacaaagcagcagaagggaataacgtagagattttaaagactgccatagaagcaggatatcgctattttgatactgcatccttttatcagaccgaagattttttagggcaggcgatccgtgaaagcaatcttccaagagaggattttttccttgtatccaagatgtggaaagatgaaatgggatatcagcagacaaaggatgcattagaaaagagtctgaaaagacttggtaccgattatctggacatctatctgatccactggccaagaccgtcggctgactgtgagaactggaaagaactggatcttgagacctggagggcgatggaagaacttcagaaagaaggaaaaatccggggacttggactcagcaattttcttccgcaccatattaagaacattctggagaatggaacagtaaaaccagttgtcaaccagctggaactgcatccgggttatatgcagcaggctgctgtgcagtattgtaaagagcatggtattcagatgcaggcatggagcccgatcggaagacggcggattctggaagagggactgatccttgaacttgccggaaagtatcaggtttcaccggcgcagctgtgtctgagattcctgcttcagaatgatatcattccgcttccgaaatcatcttcgatggagcggatgaaacagaatatggatctgttccattttgagatcagcgaagaggatgtatcgagactggcaactatgccacaggcaggatggtcaggagaacatccggatccggagcttgcacagaaaaatgttgtataatcagaaattataaaataaagagaggaacaaaaagactatgaaaatcacattaaaagatggatcaagcaaagaatatgcacagagcatgtctgtaattgatattgcaaaagatatcagtgaaggacttgcaagggttgcaacagcaggagaagttgacggagaagttgttgatttaagaactgtgatcgacaaagactgtgagctgaacattcttacattcaatgatgaaaaaggaaaaggtgcatttcgtcacacaacatctcacattatggcacaggcaatcaagagactgtatccggatacaaaacttgcgatcggaccttcaattgaagatggattctattatgatattgaccgtgagactccgcttgtagcagaagacctggaaaagatcgaagctgagatgaagaaaatcgttaaagaagatcttccaattaaacagtatacaatgccaagagcggaagcaatcgcatattttaaagaaaaagatgaaccatataaagtggaactgatcgaagaccttccggaagattccgtaatcagcttctattcacagggagaatttacagatctttgtgcaggacctcacctgatgagcacaaaaccggtaaaagcattcaaacttacaagccttgcaggagcttactggcgcggaagtgaaaagaataagatgcttcagagagtttatggtacttcctatccgaagaaagcagagcttgaagaatatctgcatatgatggaagaagcaaagaagcgtgaccatagaaaacttggaaaagaacttggacttttcatgatgagagaagaaggaccgggatttccattcttccttccaaaaggaatggaactgaagaaccagctgcttgattactggagagagatccacaaaaaagccggctatgttgaaatttcaacaccgattatgttgagccgccatctctgggaaacatcaggacactgggatcactacaaagacaatatgtatacaactgtgatcgatgatgaagatttcgctatcaaaccaatgaactgcccgggaggaattcttgtatatgaatctgaaccacgttcataccgtgaccttccgcttcgtatgggagaactcggactggttcaccgtcatgaaaaatcaggacagcttcatggactgatgcgtgtaagatgctttacacaggatgatgcacatatcttcatgacaccagagcaggtacgtgatgagatcaaaggcgttgtaaaactgatcaatgaagtttacagcctgtttggatttaaataccatgtggagctttctacaagaccggaggacagcatgggaagtgatgaagattgggatatggctactgaagcccttcgtggcgcattggacgatctgggacttccatatgtagtaaatgaaggagatggagcgttctacggaccgaagatcgacttccatctggaagattctatcggaagaacatggcagtgtggaaccatccagcttgatttccagcttccgctcagatttaaccttgaatacacaggagcagatggtgagaaacatcgtccgatcatgatccaccgtgtaatcttcggatcgatcgaaagatttatcggtatcctgatcgagcattttgcaggggcattcccgacatggcttgcaccggtacaggttaaggtgcttccgatttcagacaaatatatggattatgcacagaaggttctggatgaactgaacaattcaggtgttcgtgcagaaattgatacacgtgcagagaagattggatacaagatacgtgaagcacagatgaagaagatcccgtatatgctggttgtcggagcaaaagaagaagaggacggactggtatctgtaagaagccgttttgaaggggatgaaggacaaaagtcactgacggacttccttgcagcaatcaagatggagatccaggccaaaacagcaagggaagtaaaaaaagaagacgataaatagagttttaaataaaatctgaataagaaatagaactttcgggcataatgatactgattttcaaaaaggaggtaacattatgcctgaattaaaatgtacagtacagacatgcatgcacaacaaagatttttattgtgatctgaacgcaattacggtgggaggaaaatctgcacggaaagctgcagagacaagctgtgacagctttgaagaaagaaaaagcggcacctacagtaatgtgactggtgaggcgggtccgacaagcaagatcgactgcaaggccacggagtgccagtacaataaggaatgccagtgccatgcaggaaagatcagtgtggagggcagcaaggcatgcagctgtgatgagacggaatgtgcaactttcagttgtggatgtgcgtagatgaaagtgatgggtgtgggagagtttctcctgcacctgtttgtttgtgtgcaaggaatgagagaaaaggtgcgaaaaggatggttggggaggttgacgggggtgttagaaagaaggtataataaaaatcggacttttgaagaaagacagggaaattaaatggaaaaaaaagacaatgtagagaaaggggtttcggggaagccggaagagaagaaatcggcagcgtattatgaaaagcgtccggaatttggtaacaaagggccgtcaaagattttgctgcatttcaggaaggggattacctttttccttgttattgcggcttgtgtgattttttattttctgttactccgaatagaggatatatcagtaggtgtcagtaaagtaattgatgtgttaaagccgatcctatacggaatggtgatcgcatatttgctgaatccgatcgtaaagcagattgaccggtggctgattccacaattaaaaaagaaaatgtctcaggaaaaggcaaagaaggtttcgcgtagtgtcggtgtttttgcagcgctggttatgctgcttgctttgatcctggcactgtgcaatatgctggttccggaactttataaaagtatccgtgacatggttcagactctgccgggacagatcagtgatatggttacgaagatcataagtatccagaaagataccagtcctgccggagtcatggcacgtaacctgttagaaaagggatcggatgcattacagaactggatcaaacaggatcttttaaccaaggttaatgaagtgatgtcaaacctgacggttgggatcatcaattttgtcagtgagatcctgaattttctgattggtcttattgtatcagtctatattctgttcagtaaggaaacattttccgcacagagtaaaaagatcgtctatgcagtgctccgtacagatcatgccaatatgatcctgcatctgacaaagaaaagcaatgagattttcggtggatttattattggaaagatcattgattctatgattatcggagtgctttgcttctttggacttacgctcctgaagatgccgtacatacttttgatcagtgtaatcgttggtgtgaccaatgtcattcctttcttcggaccgtatatcggtgctattccgagtgccgttctgattttgctgaatgatccgatcaagggcttgtatttcctgatcttcattcttgtactgcagcagcttgatggaaatgtgatcggaccgaagattttgggcaattcgaccggattatctgcattctgggttgtattttcaatcctgctcggaggcagtctgtttggatttgtaggaatgatcatgggcgtgcctacatttgcagtagtttattatattattacaatgctgatcaatcatttgctggagaagaaaaagcttccgcttcagacttcggagtatggggaaaagagttatgtggatgatagcggaagatttgtcagagaaaatccggaagaaaatgatacagcggtaaaaaacggggaaaataaaaaagagaggaagtaagcagaaatgccaattcgtgtacagaatgaccttccggtaaaagaaatactggaaaaagaaaatatatttgtaatggatgagaaccgtgcggttcatcaggacattcgtccgatcaagatcggacttctgaatcttatgccactgaaagaggatacagaacttcagcttctgcgctccctttccaatacaccgctgcaggttgacattgtgtttttggcagtgaaaaatcatgtttcaaagaatacttcagcgaatcacctgaaccggttttatgagaattttgaaaatgtaaaagatcagaaatttgacggatttatcataaccggagcaccggtagagcagatgccttttgaagaggtggattactgggaagaacttgtagagatcatggagtggacaaagacacatgttacttcaacgatccatctctgctggggagcacaggcagcactttattatcattatgggattaataaagtacagctggacaaaaagcttttcggtatctttgaacataaggttatgaaccgtaagattcctctggtacgtggatttgatgatgtattttatgcaccgcattcgagacatacagatgtgccgattgagaagatccgtgcagatgagagactgatgattctggcagagtcggaaaaggcaggagcataccttatcatggcacagaatggaagacagatttttgtgatgggacatccggagtacgaccgggtgacactggatcaggagtataagcgggatctgagcaaaggacttccgattgaaatgccggagaattattatccagacaatgacagcacacagaagccacttcttacatggagagcacatggtaactgtatgtatgcaaactggctgaattactatgtttaccaggcaaccccgtatgatatggtggggacaccggattttcattaggattcagatagaatttcatataccgatatcctgaaaggcatatcagaaagtactatgtttcagaagagaaatcctttgttataataggaaagcaaaaataagcgggaggaaaaatatgttattggagcagaaaacaactgattttttggaacagctctcatcgtcagcaccgattccgggaggtggcggtgcatcggcagcagtcggagcgttcgcatcagctttgggacttatggttacaaatctgactgtcggaaaaaagaaatatgcggatgttgaagaggaaattctagagataagagaaaaacttgagcagaagaagcaggatctggtccggatggtagatgaagatgccgaggcttttgaaccactggcaaaggcttacagaatgccaaaagagacagaggaagaacaagcagagaaggaaaaagttatggaggccgcacttaaaaatgcggcagaagcaccactgtgtattatgaaaacaattgtagatactatggagatgatccgggtgctgggggaaaaaggaagcaggcttgcagtcagcgatgcaggagttgcaatcctctttgcccaggcagcccttgaaggagcttctcttaatatttttatcaatacaaagatgatgaaggatcaggaagaagctgaaagactgaattatctggctgatcaactgattgcgacaggcaaagaactgaaagagacaacttatgatgctgtacttaatggtatcagaccataacagataagacagacaggaggaagacatgagcatacagatgcgaggggctgaagtggcaaaagccatgaaagaaacgctgatcagagaaagagaagagttgaatgcggcgggagtaaatccatgccttacgatcattcgggtaggagcgaaagaaaatgatcttgcctacgaacgtggagcaaaaaagagaatggaaatgatcggaattgagtgccgcattgtagaactgccagaagatatttcacaggaagaatttgaggatgctttctgtaagatcaataaagatccggaggttcacgggattcttttgttccagccgcttccggagcagctcgatgtagagaagatcagacagatgatcgacccggcaaaggatatggatggaatgagtcctgtaaatcttgcaaaaatattcgaaggtgacagaactgcttatgcgccttgtacttctgaggcagtgatgcacattatgaatcactatggaattgaactccaggggaaaagagtgaccgtcatcggaagaagcatggttgttggaaaaccgctttccatgctgatgcttggacagaatgcaactgtaactatctgccattcacgcacaaaagatctggcggacagatgtcgcgaagcagagataatagtagctgcgatcggacgggcaaaccatatcaccgccgatatgatcgccgaaggagcggtggtagcggatgtcggaatcaacgtactggaagacggaaccctctgtggagatgtggactacgaaaatgtccgggaaaaagtatcccatatcacaccggttccgggaggagtaggaaacgtcacaacatctgtactcgcctctcacgtgctgcgtgccgcccgtataggtcagaacgaacacggacaacgcagagggtaacaccgcctctctgtcgaacacaatacaaatgggcgaagaacagttacaaccggtaacccagagcgccccggaagagaaaaaatcctatagattcaacttgaatctataggatttttttctcctccgtggtggcatagactacatttatttttcgcccatctctggtggaatcttttctaacaactgtcggatattatcacggatcaatcgtttataattatcaggaagcggtgtgatcatatccaggatctcggcattgatcggatcctttgaatgaattgaatcatccaggtagtcacagatcagataatcaaatttgacatctaatgcttctgaaaaattaagcatggttgcaaaggatgttgcctggctgccattttcaatccggcttatcgttgtctcatcaagatttagtttttctgctagtgctgcctgtgtaagaccggctttgtgacgtgcctgccgaacgcgtgtaccgaaattcttttccatgctgtatctctccttcataaaagtagtgtagcatttcaatttgaaaaaagaatgatattatatgcaagttaactttacaaaaacgctgtgataggatatgattaaaaaaaggagggagagaaatggattgggaatcgtacagaacagatattgaggcgataaagcttgcggtgaatgaatgtgaaagacttggagtggataaagaagaactcctcataatcagtatttaccgtttgtatgaattttataaaacagaagacgacagagtctatcttctgggggcattattgcatcttaaggcttatcttgagctggggatggaatatgaaaagaaccgtaagattttttcgctgattttagataattacggggtatgttatcaggatatttttcagagagctgagaaaatggagtgaaaaaatctgaaaaattccaaaaatcaggttgacaaacagagaataaagaggtaatatattaaccataaattgtaaaaccgttgagaaagaggagtaggttatcgaacgatatcacagagagcagcaggcggtgggattgctgtatggagttgataattgaatggactttcgagggcagcctgaaatcagataattgagagtatggtttgtcgggaaccaaacccgttatcaataagggatgtatgttagtacataaaagaggacaggaaactgttaaagttgagtggtaccgcgttagtagaagatattagtcgcctcaatccggagaaggattgaggcgttttttgtttcataggaaattccgaaggaacttcctatgaaataaaaagtctccggcaggatgttacatatgtattcctgctgtggtacggcgcggaatcaagaaacaccttctcttgaaagctaacaaagaaaattatttatcaagaagaggagaacaaaattatgaaaaagagaacaatcgcagtattattaacaatggcaatggcagcaacaatgatggcaggatgtggaagcaagtcggattccaagacagcagatggagaaaaaagctatacaattggtatttcccagtttgcagagcacggatctttagataactgccgtgaaggatttttagagggactgaaagaagaaggtatcgaggaaggaaagaatctgaatgttgaatacaaaaactcggcagcagatatgggaactgcatcacagatcgcaagcagctttgtatccgataaagtagatctgatctgcggaatcgcaacaccaagtgcacagacagcatacaatgctgcgatggatacggatatttcggttatctatactgcggttacagacccgaaagcagcagagcttgcagatgataaagggaacccggttggagaagtcacaggaaccagtgataaacttccgattgaagcacagctgaaaatgatccgtgaacttcttccggatgcaaagaagattggtatcctctatacaacaagtgaggcaaacagcgtatctgcaattgctgaatacaaagaaaaagtcggtgactatggatttgaacttgtagaaaagggaattacaaatacatcagaaatcgcacttgcaacagacgatcttctgtcacaggtagactgcatcagcaacctgacagataacacggtagtaagctcacttgcaaccattctggataaggcaaatgcagcaaatatcccggtattcggaagtgagatcgaacaggtgaagcttggatgcctggcagcagaaggccttgattatgtagcacttggaaaacagacaggtaagatggcagcaaaggttctcaaaggagaaaagaaagcatctgaaatgccatttgagacgatcacagaagcaggactttacctgaatacaaaagtagcagaaaatcttggaatcacagtggaagacgatctgaaaaacagcgcagtagagacatacgattctatcagcgaaaactaaatttgaattagaaaagtgaggagcaatgcaatgagctttgcagtatcgattttggagcagggactgatttatggaatccttgcattgggaatttatataacatacaaaattctggattttccagatctgaccgtagatggcagctttccattaggagctgccgtaacggcgcttatgatcacaaaaggagcgaacccgtatctgacccttccggctgcatttgcagcaggtgtggcagccggtatctgtaccggactgatccatgtcaaatgcaaggtaagagatctgctttcaggtatcattatgatgacagcgctctggacgatcaaccttcgtgtggcaggaacagccaatgtaccgttgttttcccagaagacaatctttaaaaatgatacactggataagctgcttctgtcaggattttccgcttactctacattgctcatcattctgatcattgcgttaattgtgaaaatcattctcgacctttacctgaataccaagtctggatacctgctccgcgcagtcggagataatgataaactggtaactgcaatggcaaaggatgaaggaaatgtgaaaatcctgggacttgcgatcgcaaacgggctctgttcgcttgcgggatgtattttctgccaggaagaacgtgtatttgaaatttccagtggtacaggggcgatggtaatcggtcttgcaagtgttatcatcggaaccagtattttcaaaaaaatcagttttgtaaaaacaacgacagctgtattgatcggttctatcatttacaaggcctgtgtggcaatcgcactgaagaacttcgaaccgcaggatatgaagctgatcacagccgtactattcctgataattctggtgcttagtatggagagaaagaagaaggtgaagaagaatgctggagcttagaaatattcacaaatattataatccgggtacagtcaatgagatgtgtctttttgaggacttcaatctgacgatcaatcagggcgaatttgtatccgtagtaggaagtaacggttccggtaaaacttcgatgttgaatatcatctgcggaagtattccggtagaatccggacagatcctgatcgatggaaaagatatcacaaaggtaaaagaatacaagagaaaccagaagatcggacgcgtgtaccagaatccatctatgggaacctgtccgtccatgacgatcttggaaaatatgtctcttgcggacaataaaggaaggttctacggacttggacggggaactaataaggcacgtattgattattacagagaacagctcgcccagcttggtcttggactggaagataagcttcatgtcaaagtcggatcactttccggaggacagcgccaggcgatggcactgctgatgtctacgatgacaccaatcgagtttttgatcctggatgagcatactgctgcgctggatccaaagacagcagaactgatcatggagctgaccgataagattgtaaaagaaaaaaatctgacaacggttatggttacacacaatctccgctatgcagtagaatacggtaatcgtctgatcatgatgcatcagggacattgtgtgatggataaggcaggaaaagataaagaggatacctcgatcgatgaaatcctgacgatgttcaatgagatcagtattgagtgtggaaactaaaaaatacaagattatgaattaaagagataagcagaaaaggaaacagtttcggcttatctctttttgtatttccaaaggttttggaaaaattattcgaggattttcaaaatgaaaggctattgtctgaatacagaaggagaagcctatccggtataaaatgtcaatggattttcaggaatatgcctgtagaagatttggttgtctggctgccggaaaattggttattttcacagattgacgctctctctgtgatagtgctaaaatagaggaaaacggtcaagatatagtatgccttttaaatagaatacaatatattgtagttatcagaaaggagaagaagatgagcttaaacaatgtgaaagttgtaaaaaaagatgggacaaaagaagaatttaacgtgcaaaaagtcgttgtggcagtcaataagtctgcatatcgtgcactgatcaaattttcacagaaagatattgattttatctgtcattttgtagaagaaaaggtagaagaactcggaatgcatgagatccagattccggaaatgcacaatattgtagagggagcgcttgagaaagtgaatccgatcgtggcaaaaagttaccgggactatcggaattacaagcaggattttgtgcagatgcttgacgaggtttataagaaaagccagtcgatcatgtatatcggggacaaagagaacagtaatacagacagtgcgctggtatcgaccaagcgaagcctgatcttcaatgagctgaacaaagaattatataagaaatttttcctgacggtggaagaattacaggcaatccgggaaggatatatttatatccatgatatgtcagcccgaagagatacgatgaattgttgtctctttgatgtgaaaagcgtactgaccggtggatttgagatgggaaatctgtggtacaatgagccaaagacactggatacggcatttgatgtgatcggagatatcgtactgagtgcggcaagccagcagtacggaggatttaccgtgccgagcgtagatgagatcctggagccttatgcgaagcgttcccatgaaaatcatctgaacaaatacagaagccttggactttcggaagaagtagcacaggagattgcctggaaggatctggaaaaagagatggagcagggattccagggatgggagtataagttcaactccgtatcctcaagccgtggagactatccatttattaccatgaccagcggaaccgatatcagcgaatacggaaagcttgtcacaaagacgatgctggaagtaagagcaggaggacagggaaagccgggacataaaaaaccggtacttttcccgaaaatcgtgttcctttatgatgaaaatttacatggacctggaaagccgggagaagatctttttgaagccggaattgagtgctccagaaagactatgtatccggactggctcagccttaccggaaaaggctatgtgccgagtatttacaagcgctacggaaaagtcatcagtccgatgggatgccgtgcattcttatctccatggtatgaaagaggcggtatgaatccggcggacgaaaaggatgagccggtatttgtcggaaggttcaacatcggtgcggtcagtctccatcttccgatgatccttgccaaatccagacaggagaaccgagatttctttgaggtactggattattacctggaactgatccggaagcttcatatccgtacttacgaatacctcggagagctgcgtgcttctacgaatccgcttgcctactgtgagggtggtttctatggcggacatctgaagatccatgacaagattaaaccggtgctgaaatcggcaaccgcttcctttggaattacggcgctcaatgaattccagcagctttataataaaaagtccctggtagaggatggagcatttgccatcaagaccatggaatatatcaacatgaaggtcaatgaatttaaaaaagaagacggctatctgtatgcgatttacggaacaccggctgagaatctgtgtggtgtgcaggtacagcagttccgtaagaaatatggaatcgtggaaaatgtatcggacagggcatatgtgagcaacagttttcactgtcatgtaaccgaggatattacaccgatcgaaaagcaggatctggaaaaccgtttctgggatctgtgtaacggtggaaagatccagtatgtaaaatacccgatcaattataacaaagaggctatcaaatcactggtacgccgtgcaatggatatgggattttatgagggtgttaatctgtcacttgcctactgtgatgactgtggtcatgaagaactgtctatggatgtgtgtccggtatgtggaagtaagaatctgacgaagattgaccgtatgaacggatatctgtcttattcgagagtcaagggagataccagactcaatgatgccaagatggcagaaattgcggaaaggaaaagtatgtaaatgcgttaccacaatataacaaaagatgatatgctcaacggggatggtctgcgggttgtcctctgggttgcaggatgtgaccattgctgtaaggaatgccacaatccggtgacctgggatccgaatggtgggcttttcttcgatgaaaaggcgaaggcagagatttttgaagaactggagaaggattatatcagtgggatcacattcagtggaggcgacccgctgcattcggcaaatgcctatgaggtcatgatgctggcaaaagagattaaagaaaaatttccgtcaaagacgatctggctttacaccggttatgaatggaaagatatcaagaatatggatattgtaaattatctggacgttctggtggacggagaattcgaggttgagaagaaagaactggatctgcactggaaaggcagcgcgaaccagatggtcattaacgtaccggagacattaggaaaaggagaaattgtattacatgaagagaattgctaaatttcacaaagtaagtctggaacagtttatggaaggatggaaggatacctttggtgagcagtatacagaggatcagatcaaggctttatatgaagaaatcaaattgccgaagcgtgcaacggcaggaagtgcaggatatgatttctatgcaccggatgattttgtgatcgagccgggaaagacgatcaagatcccgacagggatccgtgtggaaatggaagaaaactgggtgctcaaatgctatccgagaagcggacttggattcaagttccgtctgcagctgaataatacggtaggaattattgacagcgattatttctattctgataatgaaggtcatatctttgcgaaactgacgaatgataccaatgagaataaaacggtagagcttggaaaagggacaggctttatgcaggggatttttgttgagtatggaattactgtggatgacgatgcgacagcagtcagaaacgggggatttggaagtacgacgaagtagggctgtaaaaaaaggcgttaaaatataggttgtgttggcgaccgggatcaaaaaaatagtgttcaattccattgtgcaagggcattacgatgaacctctgagagcgaaaattgtgtcagcaaaggcttccacaatttttgagtttcatctccattgcacaataagtgaattgaacactatttttttgatcccggtcgccggatttactgtattagagaggcgtttttttacaaggctggactgataaccggttgaggagatttaggtagtggtgggaagggggagttggggaaaggtgaaggttatgtaggtgtagcctgcaattttgttgcaggctacaggggattagtttaattttacgttcaggtaactacggccggatagggttttgttgaaggtgatgcagaggacgacgatgaggcagccagtgaggaatccggggaggttgaagatggcggtgaggatgaggagcaggaggcgcatgaattttaatgcgtagccgagttcgaagttgggctgggtgtagttggcgatggaaacgaatgccatgtagagcatgatctcgctgttgaaccagccggattcgacagaaaattcacccatgacgataccggcgatgacgctgagtggtgtgctgagcatgctgggtgtgttgagggcggcgaggcggagtccgtcgatggcaagctccaggatcaggatctggaagatcagggggatgttgaccgtatcttcgatcagaacgaagcggaagatctccggtatccatgccgggttctgcataaagagcagaaagagtggaaccatgaagacagtcagcagtgagatcagtacacgggatattttcagatagattccggtgattggcggaaagtagtaatcatttgcctcttcgatcatatcaaagatggaggttggcaggatcagtgcagatggggaggtatcagtaaggaggatcacttttccttccatcaggcaggcgcaggctgtgtctggacgttcggtaaatttatattttggaaagggattgtaccatttgcgctgaaagagagattctgcaagagattgctgactcattttcagatcctgggatttgctttcttccagtttgttctggatcgtggtcagaagttcgcggtctacacggtcggacatatagcagagagctacgtcggtgcgtgtggaagtgccggcttcatacatttccatgatcagatgcggatcgcggatccggcggcgcatcaaggcagtattgaatacgattgtttccacaaagccatcacgggaaccgcgcagggatttgtctttatcgggttcctcgatgctgcgggacgggtaagtacggcagtcgatggcaatagcggcttcatagccgtcaataaaaagacaggtgacaccggacagaagatttttgaaaatgctgtcaaagtcaccgagaatatcaacttccacataggggatgcagcttgtagaaaaggaagttgcatcctctggcatatcatcggcggaaatattgaggaaggagtccataagtttcagcatggtttcatccttggtgaaaccatcaataaaataaaaggcactattttgaccgccgatgatcagatttcgttcgataatatcaaagctcttttttacgggaagagcccggttcatatattttgtattgtcggtgagagaagcactgacagtatgtttttccatattgaatcctccattcagagataatttaaagttaagaaaatctggaatcccggaaatattttactgcctggattctgcatagatttagcatttcacaaaaaaaggaaaatataccggattatgacaaaagttattaagaaacttaagatttttttagcatgggaaaaagattttgctatcttgcggaaaagagggtatactgtacataattataagtaatatataaatccctaaagggatgaaggaggcacacttatgagtgaatatatgatcatgacagacagtacagtagatttaccgaaggaatacctgaccgaggagcttggggttccgtatattcctcttacttatctgatcgatggacagtcttatgaggatatgattggacttaccggggaagaattttttgcaaaagtcagggcagggtcgatgccgactacttctcagatcaatccggagcaggcaagagaagcactggaaccgtatctgaaagagggaaaggatattttatatattgctttttcgtcaggacttagcggaacttataacagtatccggatggcagcagaagaattgcaggaagaatatccggagcggaagctgatcgtgattgattcactctgcgcctgcatgggagaggggcttcttgtgtacaaagctgttcagttaaagcgtgcaggaaagagtctggaagaagtggctgcctgggtggaggagaacaagcttcacatcatgcacaacgttacgattgatgatttattccatttacatagaggcggaagagtatcaaaggcttctgctattgttggaacgatgatccagatcaagccgattatccacatggacgatcatggtgaactgaaggttattggaaaagaacgtggcagaaagaaagcattgacacacatcgtggatatggcagtgaagcagtccgaaggttgggataatgatattgtgatgatcacacacggtgactgcaaagaagatgcggaatttgtggcaagacaggtggagaagaagatgggagtccacaatattctgattaactgcattggaacggtgattgggtcacatacaggtccgggggttgtggctgtgttctgtatggggaataagagataagactttgtgaagacgaggcatacaaatgaaagaattacggagacaattgaaagagctactgcaacaggcgggagcagatgtatttgaaggtcaggtttttatgatagaagaggactaagaccatttttggttgcttaaaaagatgtccttaatgtcgttaagaagaaagggagataagaaaaaaccagagcagacctggcaatcctattgttaaatagggaaagccaggaatatctctggttttatgtttgtcagaacagaaatttgttttctccgtctactgcatgcttaatgatatcctgctctttagaggtaagattaaataatttaaaaatcaattggtcaagttgctcgtaggcaatttgtgctccctcaggaggcagtccgttaattagtggttcgacagcttggatgatactgttttgcatgccggcattaacatccagaatcggaatattttcaatatgagagcgcaataccttcacggagtgaaattccattttgtaaataaactgtgcaattctggaattaaggatggcaagaatatattttatatgcagtccttcaagtttggggatgactaagttgcagctattcaaagaaagtgtttgtttatcatcataagcaaagacaagctggctgctgataaaacgatacaaaagcttttctggcgcacggtacatttctataggtgctacctgctgaaaattctgtgggttaaacacgatatagtttgagttaggattagtatggtacttacagatatcggagccttttaaaataacttcgttatctttgtttttcacggaagaaatatattttttattatttccggttacgattcctaaagcaaaatcggcgtttctggcaaggaattttgttttaggaatatgccgaattttttcaagcagctgatattcagcatccgttgtatgaaagctgaaatattcggctgaaattttacggtttgtcagaatggttgtacagtgactacagtcggatacttccattccgactgtcgaaagtggctttccggtgtgaatgagctgcaatataatgcagggacactgaaccttatcaaaggcatttcccaaaaaattaagatatcggatggaattactttccataatggcagtacggaccggtgtatgtgcctttacattaagtattgcctctggaagaataaaagagagttgtccgtttatggacaaattacgtagtgctttttcaataaacaaatcataagactctatatttttcccggaagcagtccgatagtttttgcgaagcttttccttttccgactcggaaaattcatatccccatggcggattgccgatgatatactgataagaggtttttgaatcggatgcaagataatcggcttcggttatatgctcgtacagagttttgacagaaagaatgtcatattttaaaaccatgttcaaccgggtgatttttacactgattgtatcggtgtcattgccataaatctggtcaaaacgaacatgtgctggaagctgcaataaaaaatttccagttccacagcagggatccagaattctggcatctgatgcaatatccagcttctcaatcagctttttgacgattttggtaggcgtatagtaggagccggttgccttgcggctgtcgatatttttacaggaaatgtaaatgagaccaagaatatcttcagcaggttcgtatacataatcaaaatcaaaaagcggagaatatttttcacagaaaagcagagcctgctcggaatctgcaatcaaagcatagatcagttcgtcgtatagagacagggtgatttctttttttaaaaatctgctcagcaacgctttttcatgcttgaaagaaagatcatatttttgggcgagcaaatgcagggcacagtcagcaatgaaatattgaatcacatccgatgaaagagcaatggattcatcggttacaattcggagaatctgctgcagtggttcgatattctgacaattttcagaaatataggcgctgtaaagagaatttccacagacaaatttcttgttacgtctgcttttcagcgattgatttttgcctgattgcagttcggctttcaacttttcggtatattgttttgtaaaataaggctttcttttatccgtatattcaggaataagtttgccaagcttgatccagttgcgcccggttgcggtcgaaatggaaagtatatcacataattcttttaaagagagataatcggaatctttcgggaaattcgtcattcgctcatcggaaggtttagtggccgaggcagggatcaaccagatgccgctgaccattttgcaaccctcaatccggttggtttcgcagagtttttgtatgcggcgttcagataaatggaatttcttcgaagtttcttttacagaaatataatccatagtcgtgcagactcctttttttgtataataatgatgtgagtgtcaaaagtatcaattgcttatttgcgcgagcacaaacgcaattgatacttttgacacttacatcatataataaagattatatacggcaatacgaatgaaaacaatattaatttaaaggattcaaatttggactggacgattgtttgactcatgctgattattggaaggtgaattgagcgttactatcaatttatatagttgaaaaagggaaattccttttctgataagaaattttcctaagtaaatgtcatttactgtgaacagtaactagttttgctctcataacttgaaattcatttgacagtatgatttatcctgcttataattatatacaggcaatttataaattcaagtaccaacaaaaaagacaggtactatctaaggagaaagcgttatgataaagaactatatcgaaaatgcaaattttgaagatacaggctttgcctacacattgtccctgatttccggcaaacataagatggttattctatactgtctgatggagtttgaaacggtacggttcaatgaattaaaacggtatctgaaaactatttccgacaaaacactcagtaccaatctcaaagagctggagaaagaccgactgattatcaggacggaatatccgcagatcccgccgaaggtggagtacagcctttcagaaagagggaagtcattgatgactgtactggatcaactttgcatttggggagaagagaacagattggtgaaatgatcagttcttatttttttatgtgaaaagaaggtgttattatgtggatgatatttgctgtcttatcagcggtatttgctgcgttaacctcaattcttgccaagataggtatagaaggagtgaattccaacctggcaactgcaatccgaaccattgttgtagtaatcatggcatggggcatggtctttcttactcatgcgcagaatggactggcagaaatcagtaagaaaagctggatttttttaatcttatctggattagcaacaggagcttcgtggctgtgctattataaagctttacaaatgggggatgcatcaaaggttgtaccaatagataaactgagtgtggtaatcacacttatattggcatttgtgtttttacatgaacagtttactgcaaaatcactcattggctgtattttgataggagcaggtacattgataatggtgttataaatttttaattaaatcggaaagatttggtgaaataaaaagagtatataattcgatggttggaggggatatatgaacattgtaattattaacggaagtgccagaaaaggaaacacgctgaccacaattgatgcatttataaaaggggcatcagaaaagaatgaaattgaaatcattaaaccggaaaatcattgtacatcgtatgagagcggtagaaaatgcagatggagtcagcggactggaagctgaatgcgaaatagatttacatttttataattcttgcaccaccggagaaaaaaggctatactcatattataggcatagagggagggcacataaaatgggacagtttttgaataataaagaaccatatgataaatacagaaccgtcaagaatgggccctattttgttgataagtcggagatacttgaagaattgattccggcattgcagcaggaacagcgctttttctgtattacccgtccaaggcgttttgggaagacgattatggcaaatatgatcgcggctttttttgaaaatacagaagaagaatccttatttgatgatctttatatttcaaggtataagcactataaagaacaggctggcaggcatgatgtgatctatattgatttcagtgaaatgccgaggggatgcagaaattatcaggaatatatcctcagaatccaggatggtctgatccgggatattgaagaagcgtatccagagcttgagataaaatctgatgcagcagtatgggatattttatcgcatgtttttgacaagacaggagataagtttgtttttgtaatggatgaatgggatgctgtttttcatatgtcttttattacagagcgggacagagaaaattttcttctttttctgaagcttttactgaaaggaaaaagctatgtagaactggcatatatgactggtgttcttccgattgcaaagtattcggatggatcagaattgaatatgtttctggaatataatatggcaacaagagtaaggttcagtgagtattttggattttcagatgaagaagttgacgtgttgtatgaccgttatctgaaaaatacgaaaaaaccacagattaccagagaaagcctgagagagtggtatgatggatatcatacagcctccggagaacgactgtataatccacgttctgtagtatgtgcgcttaccgacaatcaattatcgaattactgggtaagctctggcaaatatgattcggtgtttacttatatccgatataatgtggatcagattcaaaatgatctgacactgatgtttgcgggagaaaaaataccttccgggatacaggagtatgctgcgacagcacaggaattaaagacaaaagaagagatttattcagcaatggttgtgtatggacttctgacatatgataacgggatggtgtttatcccgaataaggagcttatgggcagttatgcagcaatgatgaaaaaagaagaatctttgggatatgtgtatcgtttggcaaatgcgtcctcgcaaatgttgcaggcgactcttgcgggcgatacggaaacaatggcaaagattattcagtatgcacataatacggaagtaccgattttatcgtacaataatgagacagaattatcagcaattatcaatcttgtatatctggctgcgagagaccagtacagagtggagcgggaagataaagcggggaaaggatacgttgattttattttttatccaatcagacatgatcaggattgtatgatactggaactgaaagtagatcataagccggaagaggcaattgcacagataaaagaaaaagaatatgctttgcggtttaaaggaaaaacagcagaaagaaaggaatatacaggacgcattcttgctgttggaatcagttataacagcaagacaaaggaacatgaatgtaagattgaacaactctaaaaaaagtgcagttttattacaggattctaaaatcattcattcatcagattgctataatatttcgttttgctcgcttattttatggtatagtggcggatatatgtacggaatgaaggaaatggttcatatgtccagagtagatatgtgtgggaatgttgctggaggtttgtgatatactgaggttggcttctttaactataattaggaaaaggatcaggagataaataaatatgaaaaaagttctgatacttgggtgccccggtgcggggaaaagtacatttgcaagaaaactcagagacaaaacaggacttccattgtattatcttgatatgatctggcataagccggacaggacaacgataacaaagcaggaatttgatgcaaaattatctgagattataaagcaggaagaatggattatcgatggtaattatggaagaacacttgaaatgcgttttaaagaatgtgatacggtattctttttagatctgccaacaaatgtgtgtcttgcgggcgcagaggggcgtattggaagtgaaagagaagatatgccatggcaggaagaagaactgtcagcagaattcagaaattttattatcaatttttcaagggatgaaatccctgagattaatgagatgctaagaaaatataagaataaaaatattattatattcaaatcgcgggaagagatagatgcatggaaatgaggaagagataaatgatcctacacacaggaatgcgaacggacattccggcgttctattcagaatggtttcttaatcgaataaagtaagattacgcgctgacccgcaacccatataatccaagtcaggtaacaagatacagtctgtcaccggaagttgtggatctgcttgcattctgcacaaaaattgaaaagattttcgtctataattgaagatatgaaaatatttcttttaaagaaagtgcgaaggaacaagatgagacaagctatgagtgatatgttgaaaataatccgcaggaaggagatctggtaggagccatttatgaaggaatcgcagaattcttgaatggactggatgatgcggagcgtgcagaagttttgtatgatgtttatgcagcaaatgtttatcagaatggaaacggagaagatgaacagggcagagtacttcatacgatgtttgatcaggtgattattgagaatgtttcttttaaataaacagtaagaaggaataagagaatctgtgggttgaaaaacctgcaggttctttttgcgtgtaaaaaagtttctgctaaataaaagatacaatgagccaaagacgcgtgcccggtacaagaatgtgtcattgtgcaaccatcattcattgctgtatataaaaattttaaaatcgagaaaatttcccttgcaatataccccaatggggtatataatagccatcgtagagagaaaaaataagaggtgagacgcatggaagaaaagaaagaatgttgtcactgtcataagacgaaagagcgttctgaaaaggaatacaaggacatgatcaaccgcctgagccggatcgaagggcaggtcagaggtgtgaagcgcatggtagaagaagatgcgtactgtccggatattctgattcaggtgtcggcgatcaatgcggcgctcaacagcttcaataaagtccttctggcgaatcatatccgtacctgtgtggcagaggatatccgcgagggaaaagatgagacgatcgatgagctggttgtaacgcttcagaaactgatgaaataacaggattgttatagattttcaggtgaaaagcgcaggaaaatttttacaatataaaaatggaagataaagccaaaaagtgaggtggatttttgtggaacaatatacagtaacaggaatgagctgtgcggcatgcagcagcagagtggaaaaggcagtatcgaaggtatcgggagttaccagctgttcggtcagtcttctgacgaattccatgggagtagaaggaaccgcatcccagtcggagatcattgcggctgttgaggcagcaggatacggtgcttcggtaaaaggagcagatgcaggagccaaaaaaggcgcagcaatggatgaggatgccctgaaagacagggagacaccgattatgaagcgtcgtctgatcgcatcactgtgttttctgattccactgatgtacatttccatgggtcatatgatgtggaactggccactgccgggatttctggctgacaatcatgtagcaatgggactgatccagctgttatttaccggaattatcatggtgatcaaccagaagttcttcatcaatggatttaaggggctccttcatggtgcgccgaacatggataccctggttgcactgggatcaggggcatcctttgtatacagcacctatgcattgtttgcaatgacagatgcacaggtgaagatggatatggaaggcgtcatgtcttatatgcatgagttctattttgaatcagcagccatgatcctgacgcttatcacagtcggaaagatgctggaagcgcattccaaaggaaagacaacagatgcattaaagagtctgatgaagctggctccgaagacagctgttgtcctgaaaaatggtgtggagacagaggtttccatcgatcaggtgaaaaaaggcgatatctttgtagtaagaccgggtgaaaatataccggtagacggtatcgtgctggaaggaaccagtgcagtcaatgaagcagcacttaccggagagagtattccggttgataaagcagaaagtgataaggtatctgctgcaaccatgaaccagtccggtttcctcaaatgcgaggcaaccagagttggggaagataccacactttcacagatcattcagatggtcagtgatgcggcggcaaccaaagcaccgatcgcaaagattgcagaccgtgtatccgggatatttgtgccggcggttattacgattgcagtgattacaattatcgtatggttgatcgcaggtcagagtgttggattcgcactggcaagaggtatttccgtactcgttatcagttgcccttgtgcactgggacttgccacaccggttgccattatggttggtaacggaatgggcgcaaagaacggaatcatgttcaagacggcggtatctctggaagagaccggtaaaatgcagatcgtagctttggacaagaccggaaccatcacaagtggggaaccgaaagtaacggatatgataccggcagagggtatctcagaggaagaacttttgggatttgcttatgcactggaaagaaagagcgagcacccactggcacatgcaattttacaggaagcccaagagcgcagactggatgtggaggaagtagaagacttccaggcagtacctggaaacggactttctgcagttcttgcaggaaagacgatttatggtggaaataagaaatttatccagacaaagacttctgtggatgcaggaacgctgaaaaaggcagaagatctggcagcagaaggaaagacgcctttgttctttgcgaaagaagatcagctgatcggaatcattgcggtagcagacgtcatcaaagaggacagtccaaaggcagtcaaagaactgcagaatatgggaatccatgtggtaatgctgaccggcgacaatgagagaaccgcaaaagcgatcggacgtcaggcgggtgtagatgaagtcatcgcagacgttcttccggacggaaaagaagccgttatccggaaattaaagaaaaaaggaaaagttgccatggttggtgacggaatcaatgacgcgccggcacttaccagagccgatatgggaattgcgattggtgcaggaaccgatatcgcgatcgatgcagcagacgttgttctgatgaaaagccgtttaagtgatgtaccggcagccattcgtatgagtaaagcaactttaagaaatatccatgagaacctgttctgggcattcttctacaatgtgatcggaatcccgcttgcagcaggtatctggtatccaatcttcggatggaaattaaatccgatgtttggcgcagcagctatgagtctttcaagcttctgtgtcgtaaccaatgcacttcgtctgaactggtttaaaatgtatgatgccagcacagataagaagataaagtcaaaagtcaaagaaatagaggaggaaaagacaatgacaaaaacaatgaaaatcgaaggtatgatgtgtggacactgtgaggcaaccgtaaagaaaactctggaagcaatcgaaggagtagaggcggcagaagtaagccatgaaaatggaacagcggtagtaacacttgcggcagaagtagccgatgaggtactgaaaaaagctgttgaagacaaagattacaaagtgacagggattgagtaggtttaagtccgaaaaataaagattgttagaaattaagtgaagattggctggttcataaaaaaataaaaaaagtgttgacaccatataaaatctgtggtaaattataacttgcgtaaagcgaacaacaaagaagagtatccactctcaccttagcgcaatcaggcgactaacggtttgatattgaatttataataccggatataagtattgtatgcaatagatagtggatagtctgcagctattcactatttttttatttattggaggtgcacaacaattagcgatttaatgattaacgaacaaatccgcgacagagaggtacgcgtggttagcgagagtggggaacagttaggaataatgtcagcaagagaggctatgaagctggcacaggaagcggaactggatctggttaaaatcgctccgacagcgaaaccgccggtttgtaagattatcgattatggtaagtacagatacgaacaggcaagaaaagaaaaagaagcaaagaaaaaacagagaactgtcgaggttaaggaagtgcgtctttcaccaaatattgacaccaacgacctgaacacgaagatgaataatgctagaaaatttatctcaaaaggaaataaagtaaaggttacacttcgtttccgcggtagagagatggctcatatgcagcagagtaaacatattcttgacgattttgctgagaagatgaaagatgttgctgtcattgaaaagccggcaaaacttgaaggcagaagcctgagcatggttttaactgaaaaacgttaaaaataaattatctatattaaggaggaaaacatcatgccaaaaattaaaacaaatagagctgctgcaaagcgcttcaaaacaacagctacaggtaaacttaaaagaaacaaagcttacaagagccatatcttaacaaagaagtctactaagagaaaaagaaatcttagacagtcaactatcacagattctacaaatgtaaagaacatgaagaaagttttaccatatctctaagatttggcaggaaagatagaaggaggattaagtaatggcaagaattaaaggcggaatgaacgctaagaagaaacacaatagaactttaaaactggctaaaggatacagaggagctcgctctaaacagtacagaattgcaaaacagtctgtaatgagagcccttacatcagcatacgcaggaagaaagcagaaaaaacgtcagatgcgtcagctttggatcgctcgtatcaacgcagctgcaagaatgaatggtctttcttacagcaagcttatgcacggacttaaagttgccggtgtagatatgaacagaaagatgctcgctgaaatggcagttaatgatgcagctggtttcgcagctgtagctgaagttgctaaaaaggcacttgcataattaaatcagacgatttcgtatagagtttgagagaagagggaaaaccttgtggagagaatccgcaaggtttttttatgtgaattgttgttataacaacagaatagaatgtggttgtaagctaaaataagctggtaaagttaaaggaatacaaatttttcgaataggaggatataaaggaatatgattcgtagaattattcagatagatgaggagaagtgtaatgggtgtggagcttgtgcaaaggcctgccatgagggggctatttctatggtaaatgggaaagcaaagctgatgagagatgattattgcgacgggctgggagactgtctgccgaattgtccggtggatgccattcattttgtagagcgtgaggcggcggcttatgatgcggaggctgtgaagcagaatatgcttaaaaagcagcaggaagaggctggaaagcagaatgcgggagaaggacctaaagcaccggtaaaaccatttgcagggggatgtcctggaacccgcatgcgtatgatgaacagagaggagagtatgcagaatgcagagagcgaagaggaaggaagggagacggtgaaaagcgtgaataagagtatgctttcccagtggccggtacagattaagcttgcaccggtgaatgcaccatattttgacggggcgaagcttctggtcgctgcagattgcagtgcctatgcttatggagattttcacaatcgttttatcaaagggcatgtgactttgattggatgtccaaaactggataatgtggattattcggagaagctgacggagattattaagaacaataatattaagagtgtgacgattgtgcggatggaagtaccttgttgtggcggacttgagctggcggctaagaaagcgcttcaggaaagcggtaaatttattccgtggcaggtcgtgaccttatcgcttgacggacagatccttgatgaataatatcagtaaagtaatttcattacggaaaacagcatatgaaatatgttgcggtaaatctgtagagtctgcaaaaagggcaaagaaaaaggctgaaaagttataaacttttcggccttttctgacgcatttactaatgtgttcgtacatattctttgattgcgttaaagctttctctgctgatcacgtgctccatctggcaggcatcatctgtagcaatttcttctgggacaccgagttcgatcagccattttgaaataaattcatgccgttcatagatcatgttcgcgatctcttttcctgaatcggtaagatagataaaacctgcatctgttacggtaatatgattctcctgacgaagtttcttcatggcgatgctgacgcttgattttttgaaaccaagttcgttggcaatatctacggaacgtacgacaggtaattttttacttaacatcaatattgcttcaagataattttcggaagattcatttttagccatttattccggtcacctcactatttattcttatatctaataggataccatggattgtattttttttcaaataatattgttctgtaaatgctcttttgtgcaaaaagtagaagctataactattataagtaagtgataaatggcaaaaatgagtaacagaaaacaatggtttaacaaaacttaaaaaaatgcttgacaacacacaaatgttagcatatactaactaatgaacaaaagttggtaatgaaaaaaattatcattcaaaattccaaatacgcaaaagaacaggaggtagggattatgcctttaacgatggcgaatattggtgaagtaaatgagatcaagagaattggtggaaatgaagaaacaaggcgattccttgcgaatctcggatttgtagcaggtgcagagattacagttgtttctgcaatcggtggtaatgtgatcgtgaacatcaaggattcacgtgttgcggttaattctgatatggcgcggcatatcatgatctagcctctggctggtcgatgggtccgctgtatatatattctgtattacgaagcttaaaggaaaggagatacgacaatgactttaggtgatgcaaaggttggaagcactgttgttgtgaccaggattgaaggagacggagcttacaaacgccgtattatggacatgggcataacaaaaggaagcgagctgtacatcagaaaagttgcgcctctcggtgatcctgttgagattactgtaagaggatatgaacttacagtaagaaaagatgatgcacagtgtgtgcaggtaaaatagcatatacataattatgcatgagagtagtacaacaaggaggtaaaaaggaatggcaattaaaattgcacttgccggaaacccgaactgcggtaaaactaccatgtttaacgcgctcacaggagccaaccagtatgttggtaactggccaggggttactgtagagaaaaaagagggtaaattaaaaagtaagaagacaaaggaagaagttatcgtaactgaccttccgggtatctattcaatgtctccatatacactggaagaggtcgtcagccgtgactatgtgctgaaagaaaatccggatgtgatcattgatctggtggatgcaaccaatattgaacgtaacctgtatctgacaactcagctgatcgagacaggcgttccggttgttattgcactgaacatggcagatcttcttgcgaagagaggaatcaagattgatgtgaagagactttcaatgctgcttgactgtccgattatcgagacatctgcgctgaaaggtgaaggacttgacaaactgatcgatgaagcagtaaaagttgctaagaagtcagaaatcgatcttccgaaagatatcttctcagcagagctggaaggtgctgtagcagaagttaagagcgttcttccgagttctgtttcagaagagaagaagagatggtacgctgtaaaattccttgagaacgacagcaaggtagtagagagcatgaaactttccggtgcggcagcccagacggtggaagcacagagaaaagctcttgaaaagaaacatgacgatgatatggaaagtattgtaacagacgaacgttacaaattcatccagaagattgtttcaacaactgttcagaagggaaaagaaaaacttacaacttctgataagatcgaccgtatcgttaccaaccggttcctcggaatcccgatctttatgctggtaatgtggatcgtatattatgtttctgtaacgacagtcggtacctttgtaacagattggacaaatgatgtatttgtagtagcaattcaggatgcagcaacaagcgcactttcagcgatcggtgccggtgacatggttatgggacttgttgttgatggtatcatcggtggtcttggagccgttcttggtttcgttccacagatggcgattctgttccttttcttgtctatccttgaagactgtggatacatggttcgtatcgcattcgtcatggaccgtgtgttcagacatttcggactttcgggaaagagctttatcccgcttctgatttcatcaggctgcggtattcctggaatcatggcttctaagactattgaacaggacaatgacagacgtcttacaattatgacagcaacttttatcccgtgtggagctaagcttccggttatcgctctgatgggtggtgttatttccggtgaagtagcaggatatcaggaaagttcatttatcgcaccgcttatgtatttcattggaatcgttgcagtacttgtagctgcgatcatcctgaaaaagacaaaaccgttctcaggaaaaccggcaccgttcgtaatggaacttccacagtaccatattccacaggctaagacagttctccttcatgtatgggaaagactgaaaggcttcatcatcaaagccggaacaatcctgttccttgcctgcgttgtaatgtggttccttggcggattcggatttgtagacggaagctttggcatggtagaagacagcgcagacagtcttatggcaatgattggtggcgtgatcgcaccgctctttgcaccacttggatttggcgagtggcagccggtagcagcttctatctctggatttacagcaaaagaagcaattgtttcaacaatgggtgtacttgcaaatgtatctggtgatacagaagatgcagtcaacgtagcagctggtgttgcatcttggttcccaagctcaattgcagcatttacattcctgatgttcaaccttcttgattctccttgccttgcagcaattgctacaatggcacagcagatgcagtcaagaaaatggttctggtttgcaattctcttccagaacatcttcgcttacattgtatgcctctgtgtatatcagatcggttcattcgtaacaggcggagcattcggagttggtacagcagttggattccttttccttatcgcaatccttttcatgctgttcagaccagatccgtataaaaatcagaaagtttattcaaaacgttctgtaaacgcataagatttataagaactttaaggcggaagccggatgcagaagcctgtgtccggcttccagtgtaaaagaaagacaaggtgaaggttatgatcgcaaatattgtgatagtggcactgatcgcagcatattgtatttatctgatttacaaaggttataaaaaccataaagaaggaaaaccggtcggttgtgctggatgcagcggtaactgcagttcgtgtagcggatgtagtggaaaaaccgcaccaaagaagaaagactgaaaggcggaaggcatatgggaagttcaacaggctctatgttctatgcattcggagcattcttgatcatttatcttgtaggagtcagcatatatcagttggttttatggataaagaaatggcgtgaacgccggaaggatgaggaataagatggttgatgcaattattgttctgatcgtgatcgtacttcttatttttgcattaaagggtacgcttaaacattttaaaggggaaagcccttgctgtggtggtggatctggactgatcaagacagagattgaagaaaaggttctggaacatccggcaatcggtaaaaagacggtgatggtttccggtatgcactgtgatcattgcgtgaaaagtgtaacggaagcaatcgacaaaatcgaaggtgcatctgcaaaggtgaatctcaaaaaagaagaagcagttgtaagctatgacagagaaatcgatgatgatgatctgaaaaaagctgtcgaggaagcaggatttaaggtagttgatatcagagcctaacaggcgacagcatggaaaggggctatcatggacgcgaaagaaagaataatcgagcagctgaaaagaagtggctgtagggttacgaagcagcggctcatgctgatcgatgttattttggaaggaaaatgtaattgctgcaaggaaatttattatcaggcgtctctgaaggatccgagtatcggaccggcgacggtataccgtatggtcaatacgctggaacagatcggagcgatcagccgcaagaatatgtatcgtatttcggatgagggcaataagatggaatgcatggtcgaactggaggatggaacggttcttgatcttccggaagataaatggacagcagtaattaaaactggtctggatgcctgtggattttcgggtggacagaatgtgagaaacatcacactcaaagaagcataacattgtaaaaaaacattctgaaacggaacggttcggatatggaggcaggtaccgtggttgtatctgtctctttaagataccgggaaatgagtttcttctatataaatatggatatagataactgtgaaaagttgtgtaaaaattaaggtgaaaatagcgaatttatgtcagatataatgaaaaaaagtttgacaaaactaatttcatgcaaaaagtgagaaaatttatcagaagcaaaaaaagactggatatttacagattcgtgtcatataataggcgttaatgaaaaaacaggaggtacatagatatgtttgatattactaaagtaaattggaaaaaggttggaatttttgcatcaggagttctttttggaacagccggaatcaaagcgctttcaagcaaggatgctaagaacgtgtatacaaattgtacagcagcagttcttcgcgcaaaagactgtgttatgaaaacagctacaaatatccaggaaaatgcagaggatatttacgctgaagctaagaacatcaacgaagaaagagctgctgaaatggaagaattttctgatgcagatacagcagcagaggctgaagaagctgaaaatacagagttcaacgaagtaacagagtaagaggcgcctgaacgtgaagtttataattaaacatgagatgaaaggccggatgagagtccggctttttcaaaaaagaatgacatatgaacaggctgatatattacagtattatctgctctgcaatgaatcagtcaaattagcaaaggtatatgacagaacctgtgatgcagtcattaattataccggcgacagagaagatgtaatctgtcttctgcaggaatttcactatcagacagtggaagttccggcagacgtacttgcaacttccggtcgtgaagtgaatgcgcagtatcaggaaaagctgttcaataaagtagtatttcattatgcaagaaaatggttccttccgtatccactgaatgcatgctatacatcggtcatgtcactgaagtatatctggaagggaatcaagtgtctgtgggcacgcaaaattgaggttccggtgctggatgcgactgcaatcggtgtatccgttgcacgtggggatttcagtacagccggatccgtcatgttcctgcttggaatcggtgagattctggaagagtggacacataagaaatccgtagatgacctggcaaggaccatgtctctgaacgtaagtaaggtatggctgaagacagaagatcaggaagttctggttcctgcatccaagataaaagcaggagaccggattgtgattcgtatgggaactgtgattccgtttgacggcgatatcgtggatggtgaagcgatgatcaatcaggcatctcttaccggagagtcagtgtctgtccgcaagacggttggaagctatgcatatgcaggaacggtggtcgaagaaggtgagatcacagtcggagtcaaacaggtaagcggaaacagccgctttgataagatcgttacgatgattgaagaatctgagaagttaaaatcaggagtagaaagcaaggcagaacatcttgcagacaggcttgtaccgtattcacttggtggaacagctcttacctatctgctgacgagaaatgtcacaaaggccctttcaatcctgatggtagatttttcgtgtgctcttaagctttcaatgccgatttcggtgctgtctgcaatccgtgaagcaaacctttacaatattaccgtaaagggcggaaagtatctggaagccgtggcagaggcagatacgatcgtatttgacaagactggtacacttacaaaagcaacacctaccgtggtggatgtggttccctttgatggaagaacaccggatgaactactccgtattgcggcgtgtctggaagaacattttccacattctatggcaaaagcagtagtaaatgcagcaaaagagaaaaatctggatcatgaggaaatgcattccaaggtagagtatgtggttgcacatggcatttctacaacgattgatgataaaaatgtaattatcggaagctctcattttgtatttgaagatgaaaaatgtacaattccggaaggaaaacaggagttatttgacagtcttccggaagaatattcacatctgtatcttgcaatcgagaatcagcttgcaggagtgatctgtattgaagatccattgagaggagaggcgaagacagtagttgccgagctcaagaaaacaggatttggaaagattgttatgatgacaggtgatagcgaccgtacagcttcggcgatcgcaaagcgtgtcggtgtggatgaatattattcagaagtactgccggaagataaggctgcatttgtagaaaaagaaaaagcagccggaagaaaagttattatgatcggcgatggtatcaatgattctccggcactttctgcggcagatgtgggaattgcgatcagcaatggcgcagagattgcgcgtgagattgcagatattacggtaggcgcagatgatcttggacagatcgtaaccttaagacgtctcagcaataggctgatgaagaggattcaaagtaattaccgctttatcgttggatttaattccggtctgatcgtactcggagtaaccggtgtgatccagccaacgacatcggcacttttacacaatacttcaactctggcaattgggttgaagagtatgaagaatcttctgtaaggcagaacaatttaatgatagctctaaacgtggggggtgattctctgaatcatgccccattgctggattaagaggcaaaatagctgatagtatcaaaaaggataagattgacaaatgaagggataatccatacaatgataaatagattgataaaagggaggaagaaaaaagcgtgaaaattgatctgttttcaataggaaagtttacgatacatggatatggactgatgatcgcaatcggtatcctttgttgtgtagcaatggcttcttatcgggcgaaaaagaatggtctggatcaggaagcaattgtggatattggaatttacggtgtaatcggcggttttttaggtgcaaaaattctatatgtgatcgtggagtttaagacgtttatcaaggatccgaagacggtactcggttcagaagggtttgtcgtatatggtggaattattgccggttttctgacagcaattgtatattgcagaatcaagaagctttattttctggaatattttgatctcgctgtggcaagtatttcaatggcacagggatttggaagaatcggatgttttcttgcaggatgctgctatggaagggagacaacctccagatttggtgtggtattcccggaaggtgggcttgctccggcaggtgtaaaactgatcccgacacagcttatttcgtcggcgggcgatttcctgatcatgatcgtgttacttctatattataggaagaataaaaaagacggtacaccgggaaacgtaggctttttatatatgctgctgtatggtgtgggaagatttcttgttgagtttttgagaaatgataacagagggggagcttggatgttctcaacctcccagtggatctccatggtgatcgtagcaggtggaattgtattgtatcttgtaaataaaaaaaggcataaatggtaaggaagcggaagatggggccaggttcgtccggtggacgagtgttctgcgccgaccgtagcggagcgaagacccgaaccattggttcaggtcacgttttggtactataaaaagaaaacctctgataaaaaaacagagataattttacggtaaggaagcggaagatggggcgcaactcgtccggtggacgagtgttctgcgccgaccgtagcggagcgaagacctgaaccatgggttcaggtcacgcttcggtactataaaaaggaacctctgataaaatcagagatccctttttataatgcggaagatgggacttgaacccacacaagcgcaatgcttacaagatccttagtcttgctcgtctgccagttccgacacttccgcacaaaaatatttaattaccggattcggataaatccgaatgcggaagatgggacttgaacccacacaggcgcaatgcctacaagatccttagtcttgctcgtctgccagttccgacacttccgcatatcactcagtgagctttgtttttaactgctcgccgctgacaaaagctataatactatattccaaacgcaaagtcaacaaaaaattaaaagaaattttaattcgcaatatattacaaaaaatatcgaaaagataaataattcaatgattttacaaatttactttcttattatgagaaaatatagtaatatgatatataattgtatgcgttaaatgcgcgttttatcaatgaatttggggataataagagcagaaactggtgaaatggaggcattttatggagaaaaatataaaaatgaaggatataaaagaactgggagagcagcttggagaactgcaaagagtgtgcagggagaaaaaaatcccggtgatgatcgcgtttgagggttatggagcagcaggaaaagggcttcagattggtaatctgatccaggcactcgatccaagaggctttaaagtatatgcggtaaaaaatgaaacggaagaggaatggatgcatccttttatgtggcgtttctggacgaagatcccggaaaagggaagaattgcgatttttgataccagctggtaccggagagttatgattgaacgttttgaaggaaaaacaccggaaaaagagctggaaaaggattttgcatcgatccgtgcgtttgaaaaacagctgacagatgatggaatggtgatcatcaaactgtttttaaagattgaccggaaagaacagaaaaagcgctttgagaaactgcttgcttccaaggatactgcatggcgggtaagcaaaggcgatctgaagcggaaccatgattttaaagagtataaagcaatcaatgaagagatgctgcggaaaacggatgcagattacgcaccgtggacagtgatcaatgctacaaagaagaaagaagccaaagtggctgtttatcaggcggtgatccaggcaatggaagaagcagtcgcaagaaaggaactggaagaaaaaggcagtctggaaaagaaaacggaaatgaaaagggaaacagcagaatccattctggcagagacggatctttccaaatccatgccaaaagaggtttatgaggaacgcttaaaagcgcttcagaaaaagatggaacatctgcatggagagctttatcgcaggagaatcccggttgtccttggctttgaggggtgggatgccggaggaaaaggtggtgcgatcaaacgtctgacttcacatatggatccgaggggatatgtggtgaatccgacagcgtcaccgagtgatacagagaaagcacatcattatctgtggcgtttctggcgtgcaatgccgaaagccggtcatattgcgatatttgacagaacctggtacggaagagtgatggtagagaggattgaaggattttgcaccgaaaaagaatggaagagagcttatggggaaatcaatgccatggagcaggatctggtaaatgcaggagcaatcgtgctgaaattctggatgcagattgacaaggatgagcaggcgagaaggtttaaagccagacaggaaaatccgaaaaaacagtggaagatcaccgatgaagactggagaaaccgggaaaaatgggatcagtatgaggtggcggtagaagaaatgctggaaaagacttctatgccacatgcaccgtggatcgtagtggaaggaaatgataaatactatgcacgtattaaagttctggaatgcgtgacagaagcaatcgagaaacgactgaaagaagagagaaaataaaaaatgacaatcagggaacagatggaagaaagagaaaaggaatatctaagcccctgtgccacattaagcatggcttcccgggggagaaagagaaatgagccacagtgtgacatccgaccggtttttcagagggacagagatcggatcctgcacagtaaggcattccggcgcatgaagcagaagacgcaggtgtttctcctaccaatcggagaccattacaggacacggctgacgcatacgctggaagtatcgcaaaacgcccggacgatcggaaaggcgctcaggctgaacgaagatctggtggaggcaattgcactggggcatgatcttgggcatactccgtttgggcatgcaggagagagagctctgaacaatgtgtgtccgtgtggatttaaacacaatgaacaaagtgtccgtgtagtagaggtgttggagaaacagggggagggactgaacctgacctgggaagtgatcgatggaatccgcaaccacaaaagtgcgggaatgcctgcgacactggaagggcagatcgtcagactgtctgataagattgcttatgtgaaccatgatattgatgatgcagtaagggcggggatcatgaatgaagaggaactgcccaaagagctgcgaaaagttctgggcaacagtaaaagagagcgtttgaacacacttacccatgatgtgatcgtaaacagcatggacaaaccgaagatctgcatgtcagaggaagtccgtgaagcattgatggagctgcgggcatatatgtttacccatgtttatgagaattcacttgcaaagggcgaagaggacaaagcaatccgaatggtcgaagatctgtattcttattatgaaacgcacatggaaaagatgccggagcagtatctgaaacagctgcagaagggggaaatgccggagatcgcagtgtgtgattacatagcaggaatgacggataattttgccgtgaaaaagtttgaagaaatttttattccacaatcttggaaattttaaaggaaataaaaaagttttgtcgaatatatattatgtaggggttgcgcaaggtgcgcgaaccctgccaggaaggtgtaggacataatgtattattcagatgagattatagaagaagtaagatcgaaaaatgatatcgtagatgtgatttccggatatgtgaagctgaagaagcaggggagttcgtatttcggactttgcccgtttcacagtgagaaatctccttctttttctgtgagcagggataagcagatgtattactgctttggctgcggagcgggagggaatgtatttaccttcattatggagtatgagaattattcttttgtagaagcactcaagtttctggcacagcgtgccggtgtggagcttccgcaagaggaatattcaaaagaagcgaaagaaagagcagatacgagaagtgcgctgcttgagatgaacaagctggcggccaagtattattatgcgcagctgaagacggagggcggaaggcaggcaagagaatatctgcagaaccgtcagttgagccaggagacgatcaccgcatttggacttggatattccagcaaatacagtgatgatctgtttcgatacctgaagatgaagggttatagtgaagagatgatcatcaaagccggtctggtaaatgtcgatgaaaagcacggagtttacgacaaattctggaaccgtgtcatgtttccgattatggatgtgaataaccgtgtgatcggattcggcgggcgtgtgatgggcgacgggaagccaaagtacctgaactcaccggagactctgatctttgataagagccggaatctgtacggacttcaccgggcgagaacatcaagaaagccgtattttattgtatgtgaaggctatatggatgtaatttcgctccatcaggcgggatttaccaatgcagttgcatcacttggaactgcacttacagcaggacatgcagcattgatcaaacggtatgtgaatgaagtctatctgacctatgacagtgatgaagccggaactaaagcggcgctccgggcagctccgatccttcgggaggccggtgtgacgacccgcgtgatccggatggaaccgtacaaggatccggatgaattcatcaagaatcttggagctgaggcatttgaagagcggatcaggaaagcaaggaacagctttatgttcggtcttgagatgctggaaaaaggttatgacctgaatgcaccggaaggaaagacggaattcctcagagaagcggcgagaaggctggcacgttttgaagaagaaattgaacgtgataattacatagaagcggtggcaaagacttatcacgtcggctacgaagaacttaagaagctggttgtcaaggtagcagtccagagcggaatggcagctccggccacaaagccgagacagacgatccgccaggaaacgccaaaagaggatggtcatatccggtcacagaagattctgcttacctggctgatcgacagggaagagctgtttgatcaggtaagccgttatgttacgccggaggattttacggtggagctgtaccggaaagttgctgaacttctgtatgaacagcatgcaaaaggagaactgaatcctgcgcagatcatgaattattttacagaggaagaggaacaccgcgcggtggcagcacttttcaatacgagaatcaaaaagctgacgactgcgggagagcaggaaaaagcgatcaaggagacgattctccgggtaaaggagtacagtatcgaaaccgcaacccggaatctggatccgacagacattcaggggctgcaaaggcttatgaatgcgaagaaggcagtgcaggaccttcataaactgcatatttccattaattagggatagaatataaacaagcgatgagaggaaggacactacatggaagagaacgtagtaaagtttcaggaaaaattaaaaaatctggttgcccttgcgaagaaaaagaagaacattcttgaaatccaggaaatcaatgatgcattccgggatatggagctggaaccgacacagatggacaaggtatttgagtacctggaggccaatgggatcgatgtgcttcagatgaatgatgactccaatgtggatgatgatgatctggagatcatgctttcggatgaagacgaagtggatatggagaagatcgacctgtctgttccggacggaatcagcatcgaagatccggtccgtatgtatctgaaggagatcggtaaggttccgcttctttcagcagaagaagagattgagctggcaaagagaatggcagatggtgatgaagaagcgaaaaagcgtcttgcagaagccaacctgcgactggtagtcagcattgcaaagcgttacgtgggacgtggtatgctgtttctggatcttatacaggaaggaaaccttggacttatcaaagcggtagagaagtttgattatcagaagggatttaagttcagtacctatgcaacatggtggatccgtcaggcaatcacacgtgcgattgctgaccaggcgagaaccatccgtataccggttcatatggtagagacgatcaacaaactgatccgtgtatccagacagttactgcaggagcttggacgtgaacctacgccggaagagatcgctgcagagttggacatgccggtagaccgtgtgcgtgaaatcttaaagatttcccaggaaccggtttctcttgagactccgatcggtgaggaagaggacagccacctgggcgactttatccaggatgacaatgtacctgttccggcagaagcagcagcgcagacacttctgaaagaacagctggatgaagttttaagtacactgacagagagagagcagaaggttctccgcctgcgttttggtatgagtgatggaagagcacgtacactggaagaggtcggaaaagagttcgatgtcacccgtgagcgtatccgtcagattgaagcaaaagcactccgcaagcttcgtcatccaagtcgcagcagaaaattaagagattatttggattaagaagatggctgaattatcaaaaagattacaggcagtggcggatcttgtcacaccgggaatgcgtcttgcggatgtgggaacagatcacgcttacatcccaatctatctgacacagaacgggctggttccatccgcaattgccatggatattaacaaaggaccattagagagagcggatacacatatccttgaacatggactggatgggaagatcgttacccgtctttctgatggtctggtgaatttgaaaatggaagaagctgacacaatgatcgccgccggaatgggcggcggtcttgtcatacacattttgaatgaggatccggcaaaaaccagaagtttaaaggaactggtcctgcagccacagtcagagcttgcgaaagtccgccgttatctggaagaacatagatttcgtattgttgcagaggacatggtggaagaggatggcaaatactatccgatgatgaaggtgatcccgacagagcagaaaggtctttatgcggaaggtgttccggcagcagaagaagagcttgaatatggaaaatatttattagagaagggtcacccggtgatgggagaatatctgaaaaaggaactgtctgtgaatcagggcgtgtatgaaaagcttcgggtgcaggagagtgaacgcacgaaggagagaagtgcagaggttctgcatatgataaagagagcagaagacctgcttgaccggtatttttaggaggaaaatgatgatttgcagagaaattataaaagaaatagaagcacgttttccaaagcactatgctatggagtgggataatgtaggactgcaggtcggaagaagcgataaagaagtaaagcggatctatcttgcactggatgcgacggatgaagtgatcgaagaagcagcagactggggcgcggatatgctgatcacacatcatccgatgatctttaaagcaatgaaaaagatcaatgacgaggattttattggcagaagagtactgaagttgatccgggatgacatttcttactatgcgatgcataccaattatgatgtgatgggaatggcagagcttgctgggaaggtacttgaactgagtgaaccggaggttctggaagtgacgggaagcatgcattcagaatccggcgaagttccggttgggatcggaagagttgctgatctggcacagccgatggatttaaaatcctgtgcggaaatggtaaaaaaagcatttgatcttccgaatgtgaaaatttttggagagccggatatgcaggtacatcgccttggtgtttttccgggctccgggaagagcgcaatttccgtatctttggaaaaaggtgtggatgtactggtgacaggtgacattgatcaccatgaggggattgatgcggttgcgcaaaaaatggcagtaattgatgccggacactatggcgtggagcatatctttattgcagatatggaacatttttgccgggagaaatttccagaggcagagatccggacagcaaagatccggcagccattctgggttttgacgtaaggtgtttgggagcggggagaaaacagacagatttgtcaaagcgccgtaaggcagaaagaaggcggtaaatatggaacagcagatgtacaaagtacagattgacggggaagagagaagttttccggcaggaaccacatatctgcagattgccggggaatatcaggaaagatacccacatgatattgttcttgtatatgtaaatggaaagcttcaggagcttggaaagaagctgaaaaaggactgtgcgctccattttgtgacgacaggcgagacaattggaaatcttacctatcgccgtggtgtaagttttctgctggtgaaggcagtatatgatacaatcggacacgataagatagaacaggtgagaatccatttttcagtagataaagggtattattgtacaataaaaggagatcagaagctggatcagaaactgcttgcaaggattgaagaacggatgcatgaaatggcagatatggatctttcaatccggaagagatcggttcataccgatgaagcgattgaaatgttccgcaagtacggtatgaaggataaagagcgtttgttccggtatcgcagagtgtctacagtcaatatttacagtatcaatgaatttgaggactactattacggctatatggttccatcaaccggctatctgaaatattttaaattatatttatatgatgagggatttgtagtgcagatgccggaggcagctgaaccggaaaagatacctccgtttcagccacagaataagctgttccatgtgctgaaggaatctacgcgtggcggtgacatgcttggaattgagacggtaggggcactgaatgattatgtgacaggcggcagcgccaatccaaaggaactgcttctggtacaggaggcaatgcaggagaagaagattgcgcagatcgcagagcagattgcaggaaatccgcagaaaaagtttgtcttgatcgccggtccttcttcgtcaggaaagactacattttccagacggctttccatccagctccgggtaagcggtctggtcccgcatccgatttcggtggatgattactttaagaaccgtgtggatacaccgctggacgcagaaggaaagccgaattatgagtgtttggaagcactggatgtggaactttttaatcacgatctgaaaaagctgcttgcaggagaacggattgagcttccgacgttcaatttcaagaccggaaaacgggaatataacggacattatatgcagcttggtgagcaggatattctggtgatcgaaggcattcattgtctgaatgatgcgttgacccatgatctgccaaaagaaaataaattcaagatctatatcagtgcactgacccagctgaatatcgatgagcataaccggatcgcatcaacagatggacgtctgatccgccggatggtgcgtgatgcaagaaccagaggtacttcggcaaagcagacgatcgctatgtggcagtcggtgcgaagaggggaagagaacaatattttcccgtatcaggaagacgcggatgtgatgttcaattcagctcttctttatgagctggcagttctgaaagcttatgcagaaccgatcctgttcggaattgagaaggactgcgccgaatatcaggaggcgaagagactgctcaaattcctggattattttgtggggatcggaagtgagtatgttccgcagaattcgattttgagggaatttattggaggcggatgtttcgatttgtagaatgttgaagctggtcacatggtaagagaccaatatagattataggggcagtttgaatccgttccgctgtttttttagtgtgatccgtcgtcagaaataaacagaagaagagcttctgggagaatgaatatctttgttctctcaggagctcttcttctgtttgaccggaaaatacatatggaaaattcttccataaaaagagtattatgtgccggggaaggggatcacttaaatatatttatcagagtaacatatcttcaggcacaggcgctgtgaaatgcatttcttctcctgtgattggatgccggaaacgcagatgatgtgagtgcagtgcctgacggctgatatggctgtaatccggattatagagaaaatctcccggaagcggatgaccgatgtaattcatatgcacccggatctgatgagtgcgtccggtatccagctttaaggcaaccagagagtagaccggctctgtatttgtgatggaaagcctgcggtaatgggtgcaggcatattcaccatgtttaaaatcgaccatgcgctcgatggtagaaccctcttttctggcaattggagcagtgatgattccgtcttccgggacgattcccgtggcaagtgccagatattcccggtggattttccggcgtgccatcatggcagagaggagagaggcactgtaaagatgccgggcaatgatcagaagaccggtggtgtcccggtcaagccggttaatgcagcggtagacaaaaggctcgcctttctctttgaaataccatgcacaggcattggcaagtgtgttgtcataatttccctgggaagggtgaattggcattccggcaggtttattgatgaccagcaggtccggatcttcatatacgatcgaaagaggcagatctgacggaacaatattttcggagaattttgtttcggtaatccggatggcaagctggtcgccgggagtaagaagagtgcgcgccagtaccggttccccgttcagacggattccttccgtatcctctttgattgcccggatcagagaagaagaatatccatgagcttttaaaaactcatggatattggaagttttctgttcggttattgtataattcagaattctttcccacattactttgatttcacttcccgccataattcattgtagacagcatcgtttttatctccaaggaatttgaaggtctcacatccggagagctcgcttgcatccgggaatgcaatcttgctgttgcggatggactcgtcttcaatcagttcccgtgctgcttcatttggagtcgagtaggtgatgtactcaaagttcttcagtgcgatgtccggacggcagaggaagttgatgaacttttctgcattttccttatgctctgcattcttcggaattacccaggagtcgatccagatattggacccttctttcgggatcacgtattccaggtttggattttctttctgtgtgtaaatggcttcaccggagtaaataacaccgatggctgcttcgtttccgatcatcttgtcacgcacctggtcaacgacgtatgcctgaaccagtggtttctgtttgatcagaagattcttcgcttcgttcagctcgtccaggtcggttgagttcagggaatatccaagatattttaaggtaacaccgaatgcatcgcggacgctgtcctgcatcagaatgctgtccttgtactttggattccagagaacagaccaggaatcaattggttcgtctaccatggttttgttgtaaaggatcccgacagttccccagcaataaggaacagagtatttattttccggatcaaatgctttggactgatccatgtaagtctgtccaatatttttgatattcggaatattatcccagttgatctcggcgaggagatcattctcgatcatacgctggatcatatagtcagaagggcagaccacatcgtaggaaatggcgccggactgcaccttcgggtacatgatctcattggtttcgtattcttcataaactacctggataccggtttcttcttcaaagatatccaagacatccgggtccagatattcgccccagttgtagacaattaccttttcggagccggaaatctttgtctttgaattgtagaaaaatcctccggctgtaataacgatcacgagcagtgccggtacgacacgtgttacgacgagacgcatcgtgtggcgtgcacgggatggcttgcggatcgtgccgtctttttcgtgaacttctttttctggttttaaattgaccaggaagagaaggaagagcaccgttacaaacatgatcgttgagagtgcgtaaatttccggacggattccttttcgtacttcactgtaaattttggtggacagggtatcgattccaggtcctttggtaaagtgggtgatcacaaaatcatccaacgacatggtaaatgaaagcaggaaaccggaaagaattcctggaaggatatccggaaatacgactttgaaaaaagcgtagatcggagaagcacccagatccagtgcagcttcataggtccgccggttggtctgctttagttttggcatgacacttaggatgacatacgggatattaaaggttatatgtgcaatcaggattgtcgaaaatcccatgttcatacggaatgcgataaacaacagcatcatagatacaccagtcacaatgtctgcgttcagcatcggaatgttggtgacacccagcataaaggtacgaaacttgcggttcatactctggattccaatggaagccaaagttccgatcacggttgcaatcagcgcagaaagaagtgcgatgatcagggtgttgtataaggtgctcatgatcgcttcatcctggaaaagggatacataccattttccggtaaatccgccccatttggcacgggttctggaactgttaaaggacagaaccatcagtgtcatgatcggagcatagaggaagatcacgatcagcagtaaatataaattctgtaatttctttttcattagaatgctgtgccctccccgtctttatcgtatttggcgatcagagccatacttgcaatgatgaagatcatcaggacaagtgaaagtccacttcctacatgccagttgcttccctgctggaattcctgttcgatgacatttccaatcagaaggatcttgcttccaccgaggagattggaaatgacgaaggttgtaagtgcaggtacaaataccatagtgattccactgatgatacccggaacactaagcggaaggatgatcttggtaaatgtctggatatttccggcaccgagatctctggctgcggaaataacatctttgtcaatctttacaagtacattgtaaatcggcagcaccatgaacggcaggaagttgtagaccataccgaggatgatcgctgtcggtgtgttgataatgttccatgaaggcagcccgaagaaatggagaacggagttgatgacaccgtttttctccaggaggttctgccatgcaagagttctgagcagaaagttcatccacatcggaaggatgaaaacaagtactacgaagctggactggtttacatttcttccggcgaggatcattgccagaggataggcaaggatcaggcagatcactgtgctgacaaatgcaagcagaagtgcaagccccagagcctttatattctcaggtgttgtgattttggcaaggttcatccaggtgaattttccgtcattgtcagtcagaccataatagaagatcatgatcagaggaatgataatgaaagaaactgcccagaaaaggtatggccctgccaggagacgtttgctattcttcaattcctgcagcctcctcatcttcagattccggttttttcatgatctgaatatcaaacgggtcaacatggattccaacctcagtgccaaccgggaacatatcggtgctgtgcaccagccattcatagttgttggcaaggacttccatttcatagtggactcctttgaaaatcagatgggtaacgacaccctttaatgtgctttcttctggttttacaagatcgatgtcctccggacggatgaccgcatcgaccggtttgttggttccgaatccggtatccacacacgggaattcggcaccgacaatattgaccagcttatcgcgtaccatgatggcattgaaaatgttgctatcgccaatgaagtcggctacgaaagcattttccggctcgttgtagatatcttccggtgtaccgatctgctggatgtatccctgattcatgacaacaatcgtgtcagacatggtgagggcttcttcctgatcgtgggtaacgtagataaatgtaattcccagctcattttttaaacggatcagttcatactgcatgtcctggcggagctttaaatccagggcaccgagaggttcatccagaagaagaacttttggttcatttacaatggcgcgggcgatggcaatacgctgctgctgccccccacttaaagaatccggataacggttctggtaaccttccagattgaccagttttaatgcataatgaatcttatcatcgatgtaagattttgatttccctttgatcttcaggccaaaagcaatattttcagcaatggtcatatgggtgaaaagcgcatatttctggaaaacagtgttgagctgtcgtttattcggtgcaagggatgtaatgtcctttccatcgaaaattacttttccggagtccggattttcgaatccgccgaggatacgcagaagcgttgtctttccgcagccgctaggtcctaaaagtgtgagaaattcattttctctgatataaaggttcaggtcgtccagaaccagattgtctccatatgatttggaaacaccaacaatgtcaatcagtttgtttggcatatgtataatcctcctgtgtacttaaaaacttgggggagtgctgacccagatcaggcgtgccccggaagaagacgatgcttctatataatgctttgcgtggggagtaaaataaaaggattctccctttttagctttgtagaccttattgcctacgtggattttgacggaaccctgaagcacgtatccgaattcctcaccttcgtgtggaagatccgggtaggttgcaccgcccggagccagggtaagacggatcggttccatcatattgcgctgggcatttggaatgatccattcaatcgtattcttcagatcagtatcctttttttcaaaataatcctcatcaccgaagacaacctgttcttcctcgtcatcgctgaaaaattcattcagattggtgccgagacactgcagaatatcaaccagtgtggcgatagaaggagaagtaagatcccgttccagctgggaaatgaatcccttcgaaagctcactccggtctgcaagttcttcctgggtaagatttttcgcaatacggagctcccttactttctgtcctatgttcataaatagctcctttctgtaaattgtttgtaaaaataaaaataaacctagagtttagtatttctatacacacgacaaggtttattatactatagtttagagaaaaagcaaccgttttataaggaaaatggaggttttttggaaaaatagaaaacgggtaagaattgactaattttagtttagaccacctttggaccactatcaataaaaaagaaagcccaatagagttttttcgtctgactctattggactgttttaggaacttaataaatttttcaaaatgcatttttattatcttcaatccatttctgaaatccgtcaatatcattttgttttttgtaatagtctctagcctgttctgctgcctttttccatggctcataatgatcctctctatagtctggcttatttttgatattatagcggattctggcatgctgagttttacgtgcttttgtataaagtgatttgaaaggatcttttttttctttttcttcatatcctacttgtttgcaggtttttcctgcacgaaatatattgtcacaatagatttcgtcagaacgatttgaggggataaagtattttccgcaattagcacattgttttattacaatttcattttcttttagttttacacattcaaaagttaaaagagattctaagtcatttacttcataatatgaataaaattcattagcatcagcatatttacgaaacatcaatttaattgaagaacgttcagaaagaaaatattcaaagttaagagaatctttattttttatgaagcaatcaataattccatttttcaggtcagaaatccattcgttaaacaatttacgctgtggggcagcattatagtacactgaatggatcaaatcaaaaatataattcatatagccattatgccaatcaagagaattatcataaatagattcaatgtctgtatttaaaaattgtattacaaaagtaccgagtgaaagatgaacggtggcgccttcgtgatcatttgttatatctataaaagtatattcttttttgcgctcgttataaaaaaaaggtaaagtatacatctttattctccaatatatagattttagttatttataaaatgtcacaatatcgacagacgataaaaatattataaactatcttgaaacttccgtcaatatcatataggatatagacagaaactagtttcaatattaaaagtcgattggaggaagagaaagaatgtatctatctacacagggagaacagaaagcagagcttttgacaatgaagcaagcatgtgaatgcacttcattaggaaagacaaagctacgagaaatagcagaagcagctggtgcagttcgtaagataggcagaaattatagagtcagaaaagatattcttctcaattacattgaggaaaattgcaaagctgaatagcagaaagggagtacatacaaaatagcatggcaagaaaaaggaagtttcgaccaaaatcatttgaaacaatgatatctggtggcgaaccatctgcaagcatatatgcatcaatgttaaagagtcctgcttggaagaaattgaaaccacgtgcacaaattttatatttgtatatgaaaatgcaatattacggagtaaaggaaaaagataaaccggaaaggaatccgttatactttgtatttaatgagggcatatggaaaaagacatacggattatacactaataataaaagtttttatcaagatagggatatgcttgtaaaaaatggatttatagaaattgttgaaacaggaaaaacaaccagaacaaaaaatatctataaattttccgataactggcatgacagtagttagaaaacattttggctattccaaaattgccataagaagtatttaaaacttattacaggattgtaatagtgtaaggcgtttttggtaaaaacactattacaaaattgtaataactgtacccacaaaaacacagtcaagactattactgttctgtaatacgattacatagtaaatcatgatttatcattctatttggagggaatatggacagaaaaacataccgaagatacttaaagactaaacgctggcaaaagcttcggtttgaagtgctgaaacgttccaaaggcaagtgcgagcggtgcggttatgaaccttggaaacctaacggcttgcaagtgcatcatctgacttattccaatgttggaaatgagaagctagatgatctaatcgtggtttgtcctcgatgtcacatggaactgcatggaatcaccggaagacgtaagccagagaacatgaaaaagaacaactaaatagctgacctagagatacttcgacacggttaaaaaatgggtaacttgcagacacactccctcatggtaaaaaaaggctgaacaacagcatcgttcgaggtagtaaaaaaaagagtgacttgcagagactccaagacgaataaaaaatagcggttaaactgctatcgtctgagatacataaaaaggatatagcaaaacagtatgatttcaagatatttttattgaaattctgtttggaatgtctggatcataaatcaaaagtggtctaaaaagtgatacttcattgagtgaaaagctgagaaagcttgtaaaatagcggttctatggagttgtgaaagtaaatcactaatttagtattatggaaatagcagatcaggtaaaggaatatagttacgctgactgctgccggataccgtgccggggttatggtggaaacgtccccccggggcaacctcacccccaaaaacaaagaaaaaataaaaaagggacttatctagaacaggtagaaagaaaggaagtaaaaaattatgagaaaatttaaatgtgaaagcgattttatgagagaaagcactagaatttatagagcatatgttgagaaagagaaacagttaaaggatttgattgcggaaaccaattcacttaaagatttaacaaatgaagcaaaagaaagagagactaagaagattcagcatgaaatttctgaaaaaagagccggcatgaaaacacttttatctaatctggaaaatgattttgcggattgggcgtttgaatttgccgatctgacaggcgaggggcttgatagaaagcttgcaacagctctttcttctggaattagttacagtccgcaggaactgttgtatcttgccaaaaaagccggaaataatcaagctgacgcacgcttattacatgattatgcgaaatctcacggttatgagcttaaaaaatatgtttcaccagatcagaaaattgaaaagttccacaagatgaatgaaacgttcggaaaatttgcagatgatgagggcggaaaagactggtttagacttccagatgctgaaattgatattttcgttggaaatcagctttcttctgtggagattatgccggaaaatatggaaattcgtacagtagcgaagtctattgatgaagaaatttcaagagatattgcagaaaatgaaaagaaaaaagccgaaaatgctgacaaagacggcgaatttcttaacgggtttggtgttgatccagaagaaccagatacaaacttttacaagccggaagatgatgcaactgaaaatgtgagtccagaagaggaaagcgaaaacgtagatcagtaaaatggatttatcagaaatcaaaactattacacaggcaaagcagggtgacaagctcgctctgctagccttgtacaatcaatatttgcctttattcaaaaaactatgccgtaatcgtgcagattattctaatgttctggaatatgatgatttattacaagaatgctttctagctctgaaaagtaccgtaaacagctatagttttgagcgtggagcaagttttaagacgtatttatacagttgtgtgaaatggcatttaaacagagtgatcgcaaagcactctaatgtgacggaaaatcaactgacattgatactgcaaataaaaaagttccgggagaattatgaaaaacaacatggacgtatgccagataatgcccttgtgatgcgtgagttctttatttcaagggattatttacgggaattggacattttaaaggatttaaaaatcacttccatagatgttccaatcggtgaagatgatgaaagcacattatcggaactgctgcctggtgtggctgatctggaagaaaagactgtaagaaagttatctatagcggaattttgggaaattctcaatgatgttttattgcctgctgaaagtgaagtcattaaattgttttatctggataatttaacagtgtcaaaaattgcagaacatactggcgatacagaacaacaaatccggcaattacaacagcaagcactgaaaaaattgagaatgagaaagaaaatcaaagaaattatttgaagaaagaggtattaacatgagtgataattgttattttgaaatgaatgaagttgaagcgaatcttgaaaatataatgaattctttggaatttgctaattatcagcttgccactggaaatatcttttcagcggacgagcctagagatcaggcatcaattgaaaaaataaatgatttaacagatgctatttcagataagctttgtgatgctatgtacaatttgcgtgaacttcagaaaataattgatggttctacggaagtatttccagaagaaaatgatacagaagaaattacagaagagatgcaggaagtagactacgcagatgctatcccgtctttatacggtgcaaaagttataagcatcgaagatataaagattgggggcgaaaacggcatactgattgaatttgataccgtagatggcagcaaggcaaagctaatttatgctatggattcgctctatcaagtcaatgggggcgaaaaataatgtctaaaattacaccactgaaagcaattaggcgaaaatgtttggaatgctgcgccgggcaacggttagaggttcgggaatgccttttaaaaacttgccctctattcccgtttagaatgggacacagaccaccagtcgaacaatttactactgaaagcattgaaattgataactagtgtcctagccatggagttattgtaacagaaattgaaaatgagacagcaaaaaggcaaggggaaacagaccttgcctttaaaattatcattttgctttatcttcattgacgtatgactgcaaaataatgttgattaagttgtttaaacttcggttttcacgtttcgcaatctcttccagattagattttaactcttctggaattctcacagttgttggaatggtatttcccataaaaacagctcctttcaaattcattttagcatgaaagcaatatgaatacaattgtattcatattgacatctataaaaagtgatggtagaatgaatacaagcgaatacaaataaatacttttttaagaaaggaagattcaaaatggaaaatgaaaaaagacttgaagatgctttatctgatgtaaaggcagagttaagcgaactcaaaatggcattaaacgaaatcacagacaggtacgacacgtattggaatttaaacatgacagaagctataaaattttacagaggggatacaggtaatgaagttggagaagcaagttgtcgatttctttttgaacatgatcggatcatgtggcttgtgcgtactgcaagagtgtattgcgaaagtgcagagaatatttgtaaaaatgtagaaaaggagtaaaaacatggcaaggataaatgtaatgaatgcgattgaagaagcccggaaaaatatatcatcaagatacgatgtcagttttcatacattggtagagataacggaaaaatattctactaaatatcaaattgcttcggctgcattttgtctcggatatggacaagggcttaaagctgctaaagcagaaaaaagcatcaacggagtgaaaggagaataatttatgagttatacagtaaaatatacaaaaccagaaaagaaagagcctgtaaaatatgttttgatgcaggaagaaccaaaaaagataaaagttgatgtgtcaaacaacaaaaaaaatcctaagcaggagccactaaaaaacagtaagacaatattttcatataccaacggcaaagcaaaggaagaaaaacagctaatgaagcatatcgcattaactacagaagaagttgttgatcttaaaatgtattttgcacttacacatcaaagaatcacagatgaaattgaagtatgggaaagtctgaaagataatccgacagctccggcagccggaaataatctgattttctggaaaaagatggaaacactaataaacaagctaagcaaagaattacagtaggaagatgtgatattatggcagcagttataaaggggaaaaaattaccaacagggatcagaaagaaaaatacaaattcctttgaaatcagagtgaaacatgatggaaaaacatattatgaatatgctccgactctcaccgaagcaaagaaaaagagagttgatttaaaataccggcttgcgcatggaacatatatcaaaccgacaagttatacttttgatgaatggttcaatttctggattgaaaattataaaatgaattctgttaagatcggaacaatccaaacgtatcgcaattattataattcatgtgtaaaagagcgtttcggaaatgtgaagcttgataaaataaagggtgcagatattcaggcattttataatgatcttgtgaaaagcaatcataaactagctacaattaaggttataaaggcttttatgagtaatgcttttaaacaagccgtaaaagatggaataatagttagaaacccctttgatgctaccaatttaccacgcaataccaaaccagaaaaggaaagaaaagcattgaccagagagcagcagagcttgtttatggaatatgcaaaggatagctatttgtataatctttttgctgttatgcttagaactgggatgcgttccggggaaatccgggggcttcgttggagtgatattgacagaaaagaaaatgtaatacacattacaagaactctaaagtatatcaatggacaaggatttatggatgatacagcaaaaacaaaaacatcagtcagagatgtaccgttaatggctgatacaatgaattatttggaaaaccagaaaaattactggtcatttaaggtagagaaaatcgacaggtatttattttgcactgtagatggaaacccgatcagtgtccagatgttacaaacggaaattgataatgttgttggaaaaatacatgaagccgggcaagattttccacggatcacaagtcatgtatttcgtcatacattcgctacaagagccattgaagccggaatgaaaccgcaagtacttaaaactattcttggacatagttctttagctatgacaatggatttgtacagccatgtactaccagatacaaaagcggaagaaatgcagaaaatagcaagtatattttaggagagagcagccgttgaagctgctctttttgtgcagaaatttagcccacttttagcccacctctgaataaacgttggcggacatagacgaacaaaaagccccgaaaaatcaaaggattcggggcgaaaagaacaactatggaagtagatggacgataaacttgtaaacctagagtttagtatttctatacacacgacatggtttattatactatagtttagagaaaaagcaaccgttttataaggaaaatgaggtttttttgaaaaataaaaaacgggtaagaattgactaattttagtttagattatcttcagatcgcttttgaaaaattgcatgaaaaaatcttccgaatcgaaaggaaattcgagggattttagctgattaccggaaagttttgatttgtcgattccatatgtttggaagcgacaaatgataggatactaatgagggtgtgggaagctgattcctatatcctttttttgttttaaaaaacgattgaatgttataataatagcagattggagagcgattagaattgaaatcgttttacaaagacaatactaaattgtcaataggcatggaaggcgaatcaggatattatgcggatggtatctcaaacggaatctcatcgtcaatacaacgctcaattccgtccaacttctcataatgagaattattgatacttaataaagcaatatatgctatactgagaacagttgtaattcattataaatatcagataaacagttaagtggggagcgcaacaatatgcaattgggatggatagatttttcaaaggaagaccggcagaaggcattggatgtgattaaccttttgagtgaacagggagcagtcgatgaactgggaatcggtatagttcgtgatgcttttgctaattatttctttcctgggacctcaaccatccagactagagcaaagtatttccttattgtcccatatgtgctaagggaagctgttgatggcagacatggaaaggatgtcaatagagttttaagagctatagattcggctgaaaaagattgtggtatcagattgttagaagctgattccaaagcggaaggtgttattggaactcgtgtattaccaaaggactgggtagcaagaaaaccatcagatatctactggaatggaattcgtacatttggaatattctgtgagtatggtctgtctatacaggagtatgtttcattggcagtaaaactaaaagaacagaagtccgtcagtcgcatgggaaatagaaatgatgatgcggaagaaaatgagagagatgattcagatgcaggagatatcagtaatgttagattctggaatcttccgatttatcatgatgactggcgagacaaccttacaatagagttgacgcaggaggaagcattctatctggataagcagattcagaagtcaacgaaagggtctcttttggaatatgtgctgaaaaatcatattgatctgaatgaatatgacgattttgcttttttgacggctgaactatcggaaaaagtaagtgaaaagctggcatatatgatgaagcttgcctgcgattttaataatctggtgtatatggcaagagtaagatacaatgtcatgttgtcagatggcgagaatacttttgcaaatgatgaatggagcaggttacttccggatatcaggcataatgcaacagtcgatctggatgctgtctttgcagaattgcagctgataaatccaagagcaaagagctttctatgcgggatacaaacagcatttatggcatcggatacccacatggctgatgaactgattcgtaagagagaacggagcctgaaaggagcagccagagcaaagctaagcagaacaaaagaatttgatcattccaaatgggtaggcggtggaatgcttgattatagattctcaaatgccagaagaattgtgaatgacatctatgctggggaggtgagtgctgatgtttagaccggattcaaatcaagacagaactgattacagcagtattttgatgcctccggatggatatagactggacagagcggtaggtactacatattcacttgacctggaagcactcacagctgtggcgatatgtcttggattatctgaagaaacagatagtaaacttatgcaaaatccaataggtatgctgaatgcattgcagaaggtatcagataaaatcgtgctgttttgtgaagcaggacagattaaagtgcctacaaaaccgactgcactatctattttattagaaaaaatgatagtagaagtcgcactgccaaaggatagacagcttggtcggtacccgtcatttcatccgaaaacatgggtattagcatatgtaaacgctgagggagataaaaaatatctttttgtggtaatgagcagaaatctgacttttgaccggagctgggatatcagctttgcaatggatagcagtgaaaatatcagacagaagaaaaagacacagcctatttgtgatttcctggattatcttgtaacgaatgtgcacaataccagcaataatgccggaaagaaaaggaatttgattcgcggattatgtgcagacattaaggatgtttccttttcgcttgaaagtaaaatatttggcgagaattttgaagtgcttccacttggcattggaaaaaatgcttaccaaatgcaggatgatattctgttctgcaaggaaaaaggaaatgccaattcgacatttaatgagcttgtagtgatgtctccgtttttgtcagaaagtgtgattgctgattttaaccttacagacagggcattgtcagactgtaagagaacacttattaccagacgttccgagcttggaaaacttaaaacatcagatgtagataatttcaccatctatgcattaaaggatgaaattatagatggtgaggatgaaatttcagatgaactgacggataaaaagaagcaggatattcatgcgaaaatttatctgagaaggaaatattcagatgttgatctgtatcttggttccatgaatgcttcctattctgcaattaataaaaatgttgaaatgatgctgtggcttggtacaaagaatatgtatctgaatggggataaatttttagaggatatattctgtggaccggcaggagatgtaaagaatccatttgaacaggttacagtagcagatgctgttttggaaacagaaagtgataatagaaatctgctggagcagaaaattaaggacttgtgccgagtgaaaaggcaggctgtaatttcagaagataatgagaatgtcggaaagtataagatagtggttgagtttggaggtattgaatctgatagtgcaattacagtatcaccatttaattccaagcaggagcagttactagcagaacacattgagttttcagaacttgagatattacagttatctgagttctatgagattactgcaagatcaggtgatgatacgatccgaagaattattatgattcctacaaacggttttccagatgacagagaaagtgctgcagtaaacagtgttgtaaaggacagagcttcatttgtggaatatattgcttttgtattgggggatgattatattgcatccatgcttgaaggaaagcagatgggagaatccggctttttttgtaattcaagcgatgctatgccggcactttatgagaagatgcttaagacttcggtagacgaaccggaaagaataaaagatatcgggtatatactaaaaatggtcactgataatgagattataccggatgaatttcgtgaactttatgaaacgttttgtaatactttgaaaatcagaagataacgaggtgatgttgtgtcacaatttaatatagatgaaatcgaaaagcgtacccttgccggtctgaaagattttcaaagagctactgtagaaagagtggagtatcttttcagacataatcagaatcgtgtgcttgttgctgatgaggtcggtatgggaaaaacacttattgccagaggggcaattgtgaagacggcgagacttagaattgaagaaaaggatgagctgtttaaagtgatatatatttgctctaatcagaacatagcaaatcagaacattagaaaacttgatgtgacagggaaaaatagtattggctcagtagctgatacaagattatctatgcagcatttgaagattactgagcaggagaatgatcctcaagtaaaggaaggttacatacagcttattccgcttacaccagaaacatctttccgtatgacttcaggaggaggaagtgtgcaggaaagagcattaatatttgcaatcttaaagagaatacctgactttaaaggacatgcgacatctcttgaaaagtttatgatattggatgctgtaaaagcatgggatggatgggcaaaatggagctttgaaaatcgtgtggttgaatgtgaaaagatgacgaatggtgtctatccacaaaatgtaattgataagattttaaattattcggaatatagtaaaatcaaggacatgctacttaatcatttgcatgaaagaagatataataaacagcttacatattccaattattatgtaatgaataaattacgtgtgatgtttgcgagaatcagtgtatccatgctcgaaccagatcttgtaatcatggatgaattccagagatttaaatttcttctatcatctgatgacagtgagcttggcatccttgcacatagttttcttagcggacatgatacaagagtgcttctgctgtcagcaacaccatataaattgtattctacccttgaagaaattgatgaaaatcagctggacgaacattatgcagagttctttcaggttatgaacttcctttttgacgatgaggtcaaagatacaagttttaaggaaatctggaaaaactattccgttgctttaagtgaattaaaagctggagacagtgcaattatccgtatgaaagaacttgcggaaaacgccatgtatcaaggagtcagcaggacagaacgaatatctgtcatggattctggggattatacagatgacagcagtgtgaaacaccatctgcggatagacgggaacgatattaattcttatatacagatgtcacgattattgtcaaaaacagattcaaaacatacgttgccggtagattatgcaaagagttgtccttatcttatgtcttttatgaaaaaatacaaaataaaagagcagatagaaaaatattatacgaaacatcccgatgaatttggaaatgaaagagaacagaaccttttgtggctgaatcgtaacaaaataaataaatatgatgaactgccgaaaactaatgcaaggcttgaggcattgaaagaaaaggcatttattggtggggcggaaaaatacctgtggattccaccatcaatgccatattatgagatgcagggagcatataaaaacagcaaagggttttcaaaaatacttgttttttctgcatgggagatggttccacgaatgattggtgctatggtttcctatgaggcggaaagacttacagttggaaaattggtacatcagataaagaaccaggataagaagaatacaggttattttgcggaaggttcgagaagatacccagtggcaagactgaggtttaatgtctcaaatggagaagtaagaggcatgagcctatttgcactgctttatccatctaagacactttcggatatgtatttaccgattgagtcattgaataatcatgaatcattggaagttatagaaaaatcggtacggctgaaattgaaagagaagcttgcagtaatcaatgaaaagtatggtgatttgtttagcaataaggaggatgccagatggtattatctcgcaccgatgctcatggatggagtcatttatgcaaaacattggatagacgatattgtgtgggaaatgaatgttgatgaagaagatacaacatctgaggttagaagcagttcgaaggataaaagaaataaaggatttcttgctcatattgataggctaagaagttatctcgatgcaccggaagagattcatcttggaagaaagccggatgatcttctggaaacattggtaaatatggtattaggatcgccagcaatatgtatttatcgttcaaatggaagaagcacagccagagcaacatcactggcaaaagtgtttgtgaataattttaacttaccagagtcaacagctatcattgattttgcctatggcagatgcagagatgataattctcattggcagaatgtacttaaatactgtaaagatggctgctttcaggcgatgattgatgagtatatccatatgttgaaggaaacggcgggttttcagtcagagggcaaccagtatcaaatcgttcatgatatgatgatggattcattgaaaatacatacagctacctatatcgctgatacttatcctgatttcaaaaagcgtatcaatggagctgacaagaaaagtgacgggtgtcgaatcaggtcgagttatgcggtaggatttacaaaggatgcgggagataattccaaggtagtcatgcgtaaagaaaacattagaaatgcatttaattcaccaatgcgtccgttcgtgcttgctacaacatctatcgggcaagaaggacttgattttcataattactgtcgtgtgattatgcactggaatcttccagggaatccgattgatcttgagcagagagagggcagaattaatagatttaagtgcctggcaatcagacagaatgttgccgataaatatgggaaagcggaggacatcacatttaagcgggacatatgggcagaaatgtttgaggcagccaaagcggaaaagcaggatgaccagtcagagcttgtaccattctggtgtttcggaaaaaatcagagtgtaaaaatagaaagacttgtaccaatgtatcctatgagtaaggatgaggttaattatgaaaggctgataaagatactgtctctttaccggcttacattaggacaggcaaggcaggaagaacttctggaatatttattcaaggagttcaaggacacaagtggattgaagaaactgtttatcgacttgagtccattttcaaagggaaaagaaggttgatgtgatgagaatacttttttgtaacatagcgtggatgaaggagtatcgaggaaatgaagatggaaaggatattccgttaaatggtggaagttttgttgacgagacaggagacgcacatgaaaaatacaattttacgccggtgaatatggagggcagggaagggttatattgtctgggattcttcgagacaaaatcacataatggtaaagatgtcaatcaaatgcgaattgagaatattgcggggtgtgagctattaaaaaaagaagaatcagtagatgatgtgcttgttgtgtattgtgcaaaacatccagcacataagtttacgacggtcgtgggatggtataaacatgctacagttttcagacattatcaagaggcagtgtttgctccggaagatatacaatattacaatgcaattgcaaattcgtctgattgtgttctacttcctgcgggcatcagatcaagaaaggttcagtgggaagtcccaagaaaatcaaatggttgggcttatggatttggacgggcaaatgtatggtatgccagtgaagaggatagcaggttgcaagattatcttgcaagattagaaaaacaaattaacgaatatgatggcgaaaattggattgaaaagtatgctgagtaggtgttaaacaaaggatagaacgagggaggaatagcaatggcgtatggaaagtctatagagctgtttttggtcaatggaacagcggatagcttgactatagcggagctgtcaaattggaatggaaaagcaattaagataccaagaattgaagtgtcttcgtgctatagagaggatattgctcaagcgggagtatatttcctcttttgcaaagaagatgatggaacagattcagtatatatcggagaagcggaaaatgtaaaagaacgtttgttgcaacatttgcgagactatcaagctgaaaaagagaaatattattggaccacggcagtgatttttatagggagagacctgaacaaggcattgattcgttatcttgaaaatcgatttgtagacattgcaagacagtgtaaacggtatctggtgcttacaaaaaacacatatcgaaatacggtgatgaaggaatcgcaaatagcagtcatggaagaatttattgataatgtgagaattttgataagtgttttaggatataaagtattggaacctgtcaataaaccagcagttatagaagaaaatgatggtaacgagattgaaaaagacgaaataaagctacacttggaaagaacagtgaagggaataggaaagatagaagctgatggtattcgcacatctgaaggtttcgtagtgctaaacggaagtcatattgctccagaggatgatgagacaatctcagcaggtattaaagaaaagagaagtaaagctaatattgtagagggtattctacaggaggatgttttgttttcaagtccatctggtgcagcaatgtttgtggtaggtaagagtgctaacggattgacaagctggaaaaatgcagacggtattacacttaaagatattgaaagcgatgaaacaaaatgaaactaatgttattgcgaatcgaatgagaattgaatgtgactttgtttaagtttacgaatgaaattcttggagtataggagcaagatggatatgtggaatgacatatataagcctgattcgattggaagtgagggcggtacgattattgcagatgaggaatataaagaatcgtgcaggataaccttggaaagatgtgaaaggtatgatgcaattacatgtggtgtatatggaagtatgatgcatacaactttttgtgataaaagtcatagtcaggaagtatttgataacatgaaaagagatctacaggaatttattgataaggatacaacagctgaggaagaagatattttctatgaagagtttacaagtaaatattgattggaagattggtttgatgacaggaaaatggaacagattctgcatcagaaaccggttcagctgaagcgagaggcagaatacgaacagcagagcttattcttataatggttcagaggaggaatagaaagatgcaaatatttgttgatgcagatgcctgcccagtggttgcaatcattgaaaagattgcaaaagaaaatagtattccggtaacgttgttgtgtgatacgaatcatgttctgtcatcggcttatagcgaagtgattgtagtaggggcaggagcagatgcagtagattataaactgatcagtatctgccataaaggagatattgtcgtatcacaggactatggtgttgcagcaatggcactgggaaaaggtgcttatgccattcatcaatcgggcaaatggtacacgaatgacaatattgatcagatgcttatggaacgtcatttgaataaaaaagccagaagaagttcccataagaatcatatcaagggaccgaaaaaacgaacagaagaagatgatgtaaggtttgcacagtcttttgaaaaaatgctcatgatggtacaggagaaatttcaaaagaatactaaaacaatggagacaggcagaaaggaaaacaaatgagaaaagcaatcgtatatgcatctgtacatcatggaaatacagaaaaactagtaaagggcatagcagaagaatgccaggtcgatttgattgatgctgtaaaacagccagatgtagatctgagcagttatgatatgattggatttgcatcaggaatctatttttcaaaatttcatcagtcgatattgggatttgcagagaagaatctaccggacgataaaaaggtatttctgatctgtacttatggtggaagtgcgaattataaatccataaagcagattttggacgagaagcgttctaaagtgataggaaaattcggatgcaagggttatgacacatttggtccatttaaactggtaggtggtattgcaaaaggacatccggatgaggaagatataaaaaatacagttgagtttgtaaaaggattataagtagcccgcaaataaaaagtcaaggctaaaacttttatgtgacaaacgtagctgtctgtgatattataaagatgatataagtgaaaaagacttttacggaaacgaaagtatcttcaaattttattttacggatgtacttcctataataaaactaattacttgcaaaattgataactattattttttctgctattacaggtacaataagaacatgtaataacagaaatgaggtatagttacttgcagatagagaagtatatatcagataaaataacatctatatgtgagaagcgtgatatcagtaaatacagattatcgcagctgccgggaatttcccagtcgtcactgagagaatcatgacgcaggaaacagtaatgtcaatgctgcgtggactttggaagtaggcgaacagttcgagtatatgtatcggctgttcttttttatttttcagcgttaaagcggtgaggtttttcttatgcacgatagattgtgggagtataataacatcaatatttttgcataagtttaaaaactataaataataggatgatcggcaaaccagatgaaaatctgggacgcaaagctacagggcctgtaaaatggcagccagttgcatgaaatgagatacactgtctgtaggacagtgttttttttcatagatgtaactataataattttataaggatgacagaggaatgtgaatcaaattcatctgtttatgccaagtatcgctttttatggatctgaaaattgcagaagaaggatctgtttctgtggcgtcacaggcagaaacagatgagcatatcgcttctgtcaggctgtggcagcaaaagcgcgaaaaaagaagatgcagaaacaatcacggtgtacttattttgatgactgctatcggtcagagccagtccgagtcagaggcagatgtatattacttgtggaagacaatgaactgaacagtggcatgaattccattgattacaatgcaatttcagatcagttaactataattatggtcgcctttaaagaaggatggatacatcgggatcattggatattttgacaattaagttttttaaagagagagtagcgtatggatgattttaaaaaactcacagaacaacttttgaaaatatatattaatgccggatcagtaaataatcttggtatagaaaattattttgatgaaaatatcagtctgattggaactgggaaacatgagttattcacgaatctgcatgagtttttagaatcattcaaatttgatgtaaaacgaagaggaaaaatcagacttgaagtaagaaatttacattaggaagaagaaagacttgatgatgaccatgttcttgcacatggaacagtagattttactggtctgtttaaagatggttcaatctgttttaaaatggagacaagatttacgattatctataagtggacgaatggaaaatggatggttcagcatctgcatcattcaacaccggatctggaacagatggacggtgaagagttccctctcgcattggggaagcaggtcaaaaaaacccggcaggcccttcatgcattaggtactgcttattatcatatctcaaggctgaacttaaaaacaaagaagatagaacttgtcaaaagatctcgagaaatggatatgggtattaaagagaatactgtagattgggatcctcagttcaagattatcgaagatatttcttgcaaaaattgagaatgataaggttgagatggaatacactgtttcaaatgtccatgagtgctttgaaaattgtgtcattatgttccaacaacaggcagaaagtaaaaatcagacgatctctttgacagaacaaatcatgtatccgtatgtgtatatggatgaacctcatctgtcagaagtctgtcttaatataataagcaatgcaataaagtatgcaaatacaggaggttggatatcctgtaatgttgtacagaaatcctgtgaaaaagaagactggtgcaatatgatcattagtattaccgataatggaatcggttataaaaagccacctgtctgaggtggctttttgtgtgtcagaaattatttcaaagcccagacagttattataaaaaataaggaggaactctatggaaaagaagtctgacggtacaatagcagataaaacatacaaaatatacatgaagttttatcttggaaatcagatatcaaaataaggccaccacatcagtgccgtagaagcttttgagtttgtccattcgggcactcatgttggtgaagagcagatcgaggatcgtgattgcggccatagattctacgactacgacggcgcgtgggacgatgaccgggtcgtgacgtcctttaatgatcatttcggtgttttctccatctttggtgacggtggactgtggctgtgaaatggacggagtcggctttactgccgcgcggaagatgatcttgcttccgtcactcataccgccgaggacaccgcctgcatggttggtgtctttggtgatccttccatcttttgtatggaaggaatcattgttgatacttccttttgtatctgcagctttaaagccgtcaccgatctcaaagcctttgactgctccgatggacagcattgctttggcaagattggcgtccagtttttcaaatacggtatcaccgattcctaccggcataccggtaacaacacattcaatgatgcctcctgaggaatcctgatttttaatacattcttccagataggcagatgctttttgggcatatgcgttgcttggcatataaatcgggttctggaaaatctcttctggatggtattcattttccggaacagataccgggccgattgctttcgtataagcatgtacttcaatgccaagttctttcaaaatcttagcagcaactgcacctgctgcaactctggcagtagtttctcttccggaagagcgtccccctcctctgtaatcacggaaaccatacttttcatcaaatgtataatctgcgtgtcccggcctgtatgtgttcataatatttccgtaatcacgggaacgctgatcctggttctgtacgagaattgaaatcggagttccggtcgtccggccttcaaatacgccggaccagatctgtgccatatcactttccttacgtccggttgtaaactggctttgtccgggttttcttctatccagataaacctggatatcctcctctgaaagagaaagccctgccggacacccgtcgatcacaacaccgatcccctttccgtgcgattccccccatgtagaaatttgaaacaatcttccataaatagatcctgccatactatataccatcctttctgtaagcttttatttataaagaattaatttgtgaatcagtcaaaacaaaaaacgaacaataaagcagaagaacacttgcgcgatgggatttgaaacatttcgtttattctatttgtcatcacaacgcaaatcattcattcccccaaaatcacctcattattataatagaagattcccatcccaacaagtgataaaaatatgaaagttaaagttatgtattgtatttacaggccccttcgtattataatgactacatattgagtggaaaaaggaagtcaatagtataaatgagtgaaaagagtatgaatgaaaaaaacgaaagaaatcttgacagcacagtagatgaaatcatggaagagatcagagagcagaatgtaagtgaggtgaaggacatcaatgaaaaagaacagaaaagcgaagaaagaccgcggaaaaagaaagtcactaaaacaaaacgtccttcaggccatcacgtatctggcgatggtgtggatcataaagcagcctcaggcgaagatcgaccggttaagaaaaaggctccgcgccggaaaaagaaagtagttcgtgaagagaccgggcttctggatctggatggagcagaagaatggcgggatgaagaagagacagcagtaccaccggttattaaaagtgcagatattttaagcagtggagatgcagaagcattcaatccggatgaggaagaaatttttgatgattctttctttgatgaagaagaggaaaagccgcatagaagaactaaacggaagaaaaagcaaggctcaaaaaagtccggtaaagtggttaaaattgtagttggcgctgtggttggagtggcagcggttgtttaccttggattttccgtatatttcatgaatcatttttattttaatacgaagatcaacggtgtgaacttctccggaaaatcagtttcggcagtagagtcatacatgaagagtcaggtagatggatatgttctcacgatgaaggaatcagacggaacagaagagaagattgccggaacagatatttctcttgcgtacaaagcaggagatgaactgcagaagctcgtaaaagagcagaatgcatttctgtggccggtctgccttggaaagacacagacaattacggcatcagtcggtgttacatatgacgaaaaccagctggataccctgattaacggtctcgagtgtatgcaggcagatcagcaagttgaaccggtaaatgcacatccggagtatgacggcaattcgtatgtagtcaaagccggggagaccggaagtaagattgataccgagaatttcaaaaaggtagtgaaagaatcaatcgaaggtttcaaaagcgagattgacatgaccgctgaagactgctatgtagaaccaaaatacacaatcgagtcagaagaagtgaagaaagcatgtgacgatatgaataagtatctgaaggcaagtatcacttatacctttggttcgaatacagaagttgtagataaagatctgatttcccagtgggtaacggtagatgataacatggcagttacctttaacagtgatgcagttgtaaaatatgtacagcagctggagagtaagtatgacacttaccagacaaagagaacatttacaaccggaggcggcaacagtgcaacggttgaaggtggagactatggatggatcattgatgaagctgccgagattgcagcccttgaagcgaatatccgcaatggagagactgtaacgagagaggcgaattattcacagactgcagcaagtcatgacggagcagactgggggaatacttatgttgaagtcgatctgacaaaccagtatctgtatctttttgtaaatggtgcaattgtgacacagggaccgatcgttaccggtaagccaagcagaggagatgctacaccgcagggagtatatattctgaaatacaaagaaaaagatacaacccttcgtggaccaaagaaggaagatggaagttacgaatgggaatcaccggttacttactggatgccgtttaacggtggaatcggactgcatgatgcaccgtggcagacgaactttggcggggactggtatctggaacatgggtcacgcggatgtgtcaacctacagtatgatgttgcagagacggtgttcaacaatgtagattccggaacaccggttgtatgtcattactaaatttgagagagaggtcaattttatgtatgaactgataaaaagggacggtcgcgccaagcgcggccgcttccataccgtacacggagtaatcgagactcctgtatttatgaatgtaggaacaattgcagcgatcaaaggggctgtttctaccgcagatcttgaagaaatcggaacacaggtggaactgtctaatacttatcatttgcatgtgcgtccgggggatcaggtagtgaaaaagcttggcgggctgcacaaatttatggcctgggacaagccgatccttactgattccggcggatttcaggtgttttctcttgccggactcagaaagattaaggaagagggtgtatacttcaattcccatattgacggaagaaagatttttatgggaccggaagaaagtatgcagattcagtcgaatttggcgtctacgatcgcaatggcatttgatgaatgtccgtccagcgtagcggaaaggaaatatatgcaggcatcggtagagcgtacaacgagatggctcgcaagatgtaaagaagagatggcaagactcaattctcttgatgatacgatcaacaaacatcagatgcttttcgggatcaatcagggtggtgtctatgaagatatccgtattgagcatgcacagcagatcgcagagatggatctggatggatacgcagtcggcggactcgcagttggtgagacacatgaagagatgtaccggatcctggatgcagtagttccgtgtcttccggttgccagaccgacctatctgatgggagtcggaacgccggcaaatattctggaagcggtagacagaggtgtggacttctttgactgcgtatatccaagccgtaacggaagacatggacatgtttatacaaagcatggtaagctgaatctgttcaatgcaaaatttgaactggatgaacgcccgatcgaagaaggctgtcagtgcccggcctgccgccgttattcaagagcttatatccgtcatctgctgaaagcaaaagagatgcttggaatgcggctttgcgttctccacaatttatattattataatcatcttatggaagacatcagagaggcgatcgaagagggaagatatgccaggtttaagaaagagacactggcaaaaatggaagaaaaagaagattaggataaaaaaattctaaaatgtcttgatgaatgtcctattattgtgtatgatggtaacagtgtctattttagcaggaggaaagaaaaatgaataatccaatcgtacttattttattttacgttgtaattatcggaggattctggtggttactgatgagaccacagaaaaaggaacagaagagagtacagctgatgttatctgaactggctgtaggagatactgttcttacaacaagcggtttttacggagttgttattgatattacagatgaagacgtaatcgttgaattcggaagcaacaagaactgccgtatcccgatgcagaaatctgcgatcatgcaggttgaaaagccggagaacaactaaatcaaattttttgaaaaagttgaaaaaaaagcattgcattttatatgcaatgcttttataatacaattattggaaacgttaccgataccgataccgaaaccgttgctgtagaaagatgtgaggtgcatattatgagaacaagcggtatattactgccggtggcaagtctgccatcaaaatatggaataggtgctttttcgaaagaagcatacaagtttgtagatacacttgagaaggcaggtcagagctactggcagatccttccgttaggcccgacagggtatggagattcgccgtatcagtctttctccacttttgcaggaaatccgtattttatagacctggaaaagctgataaaaaagggctggattacaaaagatgaatgtaaggcatatgactttggtgataatgcgggatatgtggattatgaaaagatttataactgcagatatgagatcttaagaaaagcatatgaaagaagccggatcgcagatgatgcagattttcagaaattctgtaaggagaataaagaatggctggatgattatgcgctttatacggagatcaaagccgcgaatgatgggaagagctggagtgaatgggaagatgaatatcgtctgagagatgagctggcgctggaaaaattcgccaaagagaatcgggaaggcatcctgttccagaagtttatgcaatatgaatttgcaacacagtggggtgcactgaaagcatatgcgaatgaaaaagggattgagatcattggtgatatcccgatttatgtagcgttcgacagcgcagacagttggtcgcatccggaactgttccagtttgatgagaacggacttccgactggtgttgcagggtgcccgccagatgcatttagtgcaaccggacagctttggggcaatccgctttataagtgggaatatcataaaaagacaggatatgcatggtggatgaagagaatccgtcattgtgttgaactttatgacgtgatccgaattgatcatttccgtggatttgatgaatattattccattccatacggagatcagacagcggaattcggacattgggaaaaaggaccgggaatggatattttccggacggtaaaagagaatctgggtgatgtgaaaattattgcagaggatcttggattcctgacagatagtgtgatccggatggtggaagagtccggatatccgggaatgaaagttctggagtttgcatttgattccagagagcctagcaactatctgccacataattatgataagaactgcgtagtatacacgggaacccatgacaatgaaacactggcaggatggtacagagaattaaaaaaagaagataagaagttcgcacttcgctatatgggaagaaagaaactcagtgtcaatgaagcagtatgggaaatcatccgtcttgcgcagtcgagcgtggcggatacctgtatcattccgattcaggattatctctgcctcggtaatgaagcgaggatcaatcatccgtcaacccttggcggtaattggatctggagacttcatagggatgagatctcaaaaaaacttgtgaaaaagatccgcaggatgacagaactttattgcaggatcccggagaagacagagatgctccttaaggctgaagatgcggaggacttaggagaagaaaagaaataaaatgggaatgacgattaaagatattgcgaagaagtgcggggtcggagtcagcaccgtgtctcgtgcgctgaacaatcatccggatatcaatcctgagaccaaaaagatgattttaaagacggttgaagaatcaaattttgtgccgaataacagtgcgaggaatctgaaacggaccgattcgaaatccattgcgattctggtaaaggagattgataatccatttttcgcgacgatgatgcgggtaatggaaaaaaagatccgcagacagaaatattccttttttatccagcatatgggaaaggatcaggatgaggtcgataccgcactggagctgatcaaagaaaaaaagctcagagggattattttcctgggtggggatttcaggaagaacaaagagcggattgcaaagataaaggttccgtttgttgtaagtacggcagcatttgataaactgccggagaaatgtatcgcatcctatgtatcaattgacgaccgtgcggaaagccgtaagatcgtagattatctgtgcgagaccggacataaaaagattgcaatccttgcctcggataagaaagatgagaacatcggaaaactcagactggaaggttacagggaagcactaaaggcacatggcttggaagtggatgaggaaagaatctgttatctggatgaagaagataccacttattcgatggaaaacggatatcggatgatgaaaaaactgttgaaaaaagaaacagaatttaccgcagtatttgcaatttccgatctgatggtgattggtgcatgcaaggcgcttctggaagagggaaaaaggattccggaagatgtggcggttgcaggatttgacggacttgactataccggattttatcagccggcgatcactacgatggcgcagccggttgaagagatcgcgagacagtctgtcgggattctgtttgacatgatagaaacaaagaaaagccaggaaggaaaatatcttccggcaacactgaaagaaagagaatcaactacaggaggtagaagaacatggaagcaagactgacagagattttacaggagaaattccagacaggacttgaacaggcaacgaatgaacaggtatattatgcgctgcttacactgacaaaggaacggatcaaagaaggaccgaagaacgaaggaaagagaaaactctattatatttccgcagaattcctgatcggaaagcttttatccaacaacctgatcaaccttggaatttatgatgagacagcagaggtgctgaaaaagcatgggaaaaatcttgcagagatcgaagaagttgaaccggaaccgtctcttggaaatggtggacttggacgattggcagcctgcttcttggattccattgcaacactcggacttccgggagacggaatcggactgaactatcatatgggtctgttcaaacaggtatttaccgatcacaaacaggatgaacagaagaatccgtggattgaaaaagacagctggctcaatgataccggtatttcatttgaagtcccgttcaaggatttcagtcttcgttcccatctgtatgatattgatgtaaccggatacgaaggaggaagcaacaaacttcatctttttgatgtagagacggtaaatgatgcaattgttggaaacggaatcaattttgataagaacgatatacgtgagaacctgacgctgttcctctatccggatgacagtgacaaggcaggaaatctgctccgtatttaccagcagtattttatggtttccaatgcagcacagtatattattcgtgaatgtgaggaaaaaggatatgaccttagaaagctccatgagcatgtggcaatccagatcaatgatacccatccgtctatggttatcccggaactgatccgtcttctcgtccagaagcagatcgatttcaatgaggcaattgagatcgtccagaagacctgtgcctatacaaatcataccatccttgcagaagcactggaaaaatggccggttgattatctggagcaggttgcaccgcagattgttccgatcatccgtgatctggatgcaagaattaagggaagatataaagatccgagagtccatattatcgatgaccagaatcgtgtacacatggctcatatggacatccattatggatacagtgtcaacggagttgcttatcttcatacagagatcctgaaaaatgaagagctgaaaccgttctacgacatttacccacagaaattcaacaacaagactaatggtattacgttcagaagatggctgctgcactgcaaccatgaactgactgcatggctggatgagaagatcggaccggattaccgaaaagatgcaacaaagcttgaaaaactgcttgattatgtaaatgatgaggaaactttaaagagtcttcttgtggtaaaacagaaaaagaaagaggatctggcagcttacttaaaagaaacacagggactggaaatcaatccaaattcaatttttgatattcaggtaaaacgtctgcatgaatacaagcgtcagcagatgaatgcgttatatgtgatctataaatatctggagatcaagagcggaaagaaaccggagactccgatcacggtaatctttggagccaaggctgcaccggcttatattattgcaaaggatatcattcatctgatcctctgcctgcaggagctgattgataacgatccggaagttgcaccgtatctgaaagtggttatggtagaaaactacaacgtgacactggcagaaaagctgatcccgtcctgtgatatttctgaacagatttctcttgcatccaaagaagcaagtggaacaggtaacatgaaattcatgctgaacggggctgtgacaatgggaacagaagatggagccaacgtagaaatccatcagtttgtaggggatgaaaatatctacatcttcggagaatccagtgaacaggttatcgagcattaccgcaagatggattataatgcagttgattactatatcaatgatgaagagatccgcagactggtagactttatcatcagcccggaacttctccgtatcggagataaatacctgcttcttgaactgcatgcagaactgattcgtaaagactggttcatgacacttcttgatgtgaaagattatatccagaagaaagaacaggcttacgcagattatgaagaccgcatggcatgggcaaagaagatggttgtgaatatcgcgaaagcaggatatttctcatctgacagaaccattgctgaatacaacagagacatctggcatctgtaaaatgtatatgtaaaaaacagaagtctgtcctgaaaaaacagagacagacttctgttttttgtgcaaaagtgtatttttatacggtttctgcgggaacttcctgtatttcccttattgcgggaaaagagaaggatatgctatgataaggagaaatattgctgtttgttttccggatatggaaaagtttttgggaagatccgggaagcaatagaagcagatgagaggtgaatatatggaaaaaagaagaaaaagtgcagcacttttgccggtcggtgtatttctgatattttatctgggactgggtattttatttgaatacataatgaaaattccaatggggttttataatgtaccgatcgtagtggcgtttctggcggcactcctggtcgcgtgtctgcagaacagaaaggttggctttgatgagaagctggagatcatgggacggggaattggagataagaatattatcacaatgctgctgattttcctgacggcgggaacttttgtgggagtggttggaagaagcagtgcagagagtgtggcgtattttatgctatcgatcatcccggcacggtttgcggttgccgttctgtttgtggttgcatgttttgtttcaacagcaatgggaacttcggttgggacgatcacccttctgactccgattgcggcggcagtttcgcagacgtccggtttttccctggcactttgcgtggcatcggtgatgggaggctccatgttcggggacaatctttctttcatatcagatacaacaattgctgcctgcaacgggcagggatgtgatatgaaagataaattccgggaaaatttctggatcgcacttccggcggcgatcgtatcgttggttctgatcctgatcagttctttccgggcagagatcggaacggcagttacgcacgaatacaatctgacgcagatcattccgtatgtgctggtgctggtcggcgggatcgcagggttcaacgtctttctggtacttttgacaggaattgtgtccggtgcggtgatcatgcttgcaatggggcaggtaacaccgtatgaaatgcttgctgccatgggatcaggtgtatccgggatgtttgaaacctgtatggtggcggtgctggttgctgcaatgtgtgcgctgatccgggaaaatggcggctttgatgtattgctggatgtgattcaccgtgtctttaagggatcgaaaagtggtcagctgggtgttggtattttggtagcgcttctggatgtggcaacagcgaacaataccgtagcaattgtgatggctaatccaattgcaaaggaaatggcagacgattatcagatcacaccgagaaagacggcctcccttctggatactttttcctgtatttcacagggggtgatcccgtatggtgcgcagatgctggtggcaatttcggcagtgcatgagctcggcggtgagatttctgcatttcagatcattccgaagcttttttatccgggaatgctgtttgtcagttcgctgatctttatctttgtgattccacagaaaacaggaaaataaaacagagttcactctggattttatacttttacagattaaagggttgaaacctgacgaaaaatacggtattatagtgtttaacagatttttggaacgaaaaatggtacaaaaatcacagatacatagaagggaatgacaaagatgagcctgaaaatcggagtaattaaaggtgacggaatcggtccggagattgtaacggaagcgatgaaagttcttgataaagcaggagaggtatacggatttgactgttcttatgaacagctgcttcttgggggcgcatccattgatgtacatggagtcccgcttacagatgagacagtagcaaaagcaaaagcatgtgatgccgtactgatgggatccattggaggagatgcaaagacttccccgtggtataagctggaaccgtcaaagagaccggaggccggtcttctgaagatcagaaaagaactgaacctgttcgcaaatctgcgtccggcagttttgtataatgaactgaagggtgcatgccctctgaaagaagagattacagaaggcggatttgatctgatgatcatgcgtgaactgacaggcggtctttattttggagagaggaagacagaagaagtggatggtgtgatgactgcattcgattcacttacctataatgaggatgagatccgccggattgcgatccgcgcgtttgacattgcaatgaagagaagaaagaaagtgacaagcgtcgataaggcgaatgtactggattcttcaagactctggagaaaagtagtagaagaagttgcgaaagattatccggaagttacactggagcatatgctggttgacaactgtgcaatgcagcttgtaagagatccgaagcagtttgatgtcattcttacagagaatatgttcggagacatcctttctgatgaagcaagcatggtaaccggttcgatcggaatgctggcaagtgcaagtctgaatgaaaccagattcggactgtatgaaccaagtggcggttcggcaccggatatagcaggacagggaattgcaaacccgatagcaacaattctttcagcagcaatgatgcttcgtttcagcctggatcaggataaagcagcagatgcgattgaagcagcagtttcccaggtgttaaaagatggatacagaaccggggatattatgtcagacggatgtacaaaggttggaacagcccggatgggagatctgatctgcgaaagaattcgatagtcaaggattgggaaagatacagttccgtactgctatggggaaagagaagcaggacggaactgtaatagaatagagccaaaagttacaggaggattataaaatcatgagaagtgataatgtaaaaacaggtatgcagcaggcgccgcacagatcattgttcaatgcgcttggtcttacaaaagaagaactggagagaccgcttgtcggaatcgtatgttcttataacgaaatcgttccgggacatatgaacctggataaaattgcaaatgcagtaaagatgggagttgccatggcaggtggaacaccgatcatgttcccggcgatcgcagtctgtgacggtattgcaatgggacacatcggtatgaagtattctctggtaacgagagatctgatcgcagattcgacagaagcaatggcaatggcgcatcagtttgacgcccttgttatgatcccgaactgtgataaaaatgtacctgggcttttgatggcggcagcccgtattaatgtacctacagtgttcgtcagtggcggaccaatgcttgcgggacatgtaaaaggacagaagagaagtctttccagcatgttcgaggcagttggatcctacgcagcaggaacaatggacgaatgtgatgtatgtgaatttgaaaataaagtatgtcctacctgcggatcatgctccggaatgtatacagctaacagcatgaactgtctgacagaagtacttggtatggggcttcagggaaatggaacaattccggctgtatattcagaaagaatccgtcttgcaaaacatgcaggtatgcaggtaatggaaatgtacagaagaaatatccgtccgagagacattatgacaaaagaagccatcttaaatgcccttactgttgatatggcacttggatgctcaaccaacagtatgcttcaccttccggcgatcgcacatgagattggtatggattttgagattgattttgcaaatggaatcagcgaaaagactccgaacctctgtcaccttgcaccggcaggtccgacatatatggaagacttgaatgaagcgggtggtgtatatgctgttatgaacgagctgaataagaaaggtcttctttacacagactgcatgacagtaaccggaaagacagttggagaaaatatcgcaggatgcgaaaacaaaaatccggaagtaatccgtccgatcgacaatccatacagccagacgggtggacttgcagtcctcaaaggtaatatcgcaccggacggcagtgttgtaaaacgttctgcagttgtaccggaaatgctggtacatgaaggacctgcaagagtatttgaatgtgaagatgatgcgatcaaggcaattaaaggcggagatatccatccgggagatgttgtagttatccgttacgtcggaccaaagggtggtcctggtatgccggaaatgctgaatccgacttctgcaatcgcaggtatgggacttggttcatcggtagcacttattacagacggccgtttcagcggtgcatcccgtggagcttctatcggacacgtatcaccggaagcggcagtcggcggtccggtagcactgatcgaggaaggcgatattatcgagatcgatatcccgaacctgaaattaaatgcaagaatttcagatgaagaacttgcaagaagaaaagaaaaatggcagccaagagaaccggaagttacaacaggatatcttgcaagatatgcagcaatggtaacttcaggaaaccgtggagcagttctggaagttccacacaaataaaataaaatctggacaaggggaatgtacaatgcagttaaatggtgcagaaatactgatagagtgtttaaaagagcaaggcgtggataccgtattcggatatccgggcggcgcaattttaaatgtatatgatgaattatataagcatagtaatgaaatcagacatatccttacatcgcatgagcagggagcttctcatgcggcagacggatatgcgcgtgccactggtaaggttggggtgtgttttgcaaccagtggacctggagcaacaaatctcgtaacaggaatcgcgaccgcatttatggattctattccgattgttgcgatcacctgtaatgtaggggtaccgcttcttggaaaagacagcttccaggaaattgacattaccggtattacgatgccgatcacaaagtataattttattgtgaagaatgtcaatgatcttgcaaagacgatccgcaaggcgtttgagatcgcacagtccggaagaccgggaccggtgctgatcgatatcccgaaagatgtgacaggcaataaagcagagtatgagcctgtcaaaatccagccaatcgtaaaatacaaaaaagaaatctgcatggaagatattgacaaggcagtagagatgatcgaagaagcaaagcgtccgtttgtattcgtcggaggcggagctatattatctgatgcaagtgaagaactccgtgcattcgtagacaaggtacagtgtccggtatgtgattccctgatgggaaaaggtgcatttccgggaactgatgaactttatacaggaatgcttggtatgcatggtaccaagacatcgaactttggagtcagtgaaagcgatcttctgatcgtagtcggtgcaagattctccgaccgtgtcacaggtaatccaaataaatttgcaagtaatgcaaaaattctccagtttgatattgatgtggcagagatgaacaaaaatgtcattatcgatgaaggtgtggttggagatatcaaagaagtgcttgcggcagttaatgaaaaactgccacagcaggaacacaccgaatggatcaaaaagatccaggaatataaagcaaaatacccgcttgcctatcatccggaaagtctgaccggtccgtatgtgatcgaagagatttacaaacagacagaaggtgatgcgatcatcgtcacagaagttggacaacatcagatgtgggcagcgcagtattataaattcacaaaaccgagaacactgcttacgtcaggtggtcttggaaccatgggatacggtcttggagctgcaatcggagccaagatgggaagaccggagaagacggtagtcaatatcgccggagacggatgcttccgtatgaatatgaatgaagttgcaacagcggcgcgttataacattccaattatccaggttgtagtgaacaaccatgtgcttggtatggtaagacagtggcagaatctgttttacggacagcgctattcagcaactgttctgaatgatgcagtagattttgtgaaactcgcagaagcgatgggggcgaaagcggtaagagctacgaccagagaagaattcgcagatgcatttaagtttgctttaaatgcaggcggtccggtggtgattgactgccagatcgacagcgatgacaaggtatggccgatggttgctccgggtgctccgatcagtgaagcttttgacgagaaggatctgcaggaaaaacagcagacaaactaaaaaacatatgcagcgacagatacgcagagcaggaatggaggagtaatatgaaacgagtttacaatttttcagcaggaccggcagtactgccggaagaagttttacgagaagcagcagatgagatgctggattacaaaggatgtggaatgtccgttatggagatgagtcatcgctcgaaagcttttgctgaaatcattgaaaccgctgaacaggatcttcgtgatttgatgggaatcccggataattacaaagtactgttccttcagggtggcgcaagccagcagtttgcaatgattccaatgaatctgatgaagaacaaagtagcggattatattgttaccgggcagtgggctaaaaaggcagctgccgaggcatccaaatatggaaaggtgaataagatcgcatcgtccgaggataaaaccttttcgtacattcctgactgttcggatctgccggttgatgaagatgcagattatgtatatatctgcgaaaataatacaatttacggaaccaaattcaaggaacttccgaacacgaaaggcaagacactggtagcggatgtatcatcctgcttcctgtctgagcctgtagatgtgacaaaatatggtctcatctatggcggagtccagaagaatatcggaccagcgggtgttgttatcgcgatcatccgtgaagatctgattacagaggatgtacttcctggaacaccgaccatgcttacatacaagacacatgcagacgcaggttctctttacaatacaccgccggcatacggaatctatatctgcggtaaggtatttaaatggctcaaaaagatgggcggactggaagttatgaaagaacgcaacgaaaagaaagccaaactgctctatgattacctggatcagagcaaactgttcaaaggtacggtagaaaagaaagaccgttctcttatgaatgtaccatttgtgacaggcagtgatgagctggatgccaaatttgtaaaagaggcaaaagaagcaggtcttgagaatctgaaaggacaccgtactgttgggggtatgcgtgcaagtatttataacgcaatgccatacgaaggtgtggaagctctggttgcatttatgaagaagtttgaggaggagaatctgtaatatgtataaatatttttgcctaaacccgatttctcctgttggactggagaaattcagtgatgactatgtgcctgccggtgagatggcaggagcagatgcggtacttgtaagaagtgccggaatgcatgaactggaatttgataaagatttaaaagcgattgcccgtgccggagccggtgtaaataatattccactggacaaatgtgcggagcagggaatcgttgtatttaatacgccaggggcaaatgccaatggtgtaaaagagttggtgatcgccggtatgctgcttgcatccagagatatccttggcggtatcaactgggtacaggagaacgaagaggatggcaatattgccaaagatgcagaaaaagcgaaaaaagcatttgcaggctgtgagatccagggaaagaagcttggtgtgatcggtcttggtgcaatcggtgtcctggttgcgaatgcggctacgcatcttgggatggaagtgtatggttatgatccatatgtttctgtagattctgcatggagactttcaagaagtatccatcacactaagaatgtagatgagatctacaaggagtgtgattatatcacaatccatgtaccggcactggaagatacaaagggtatgatcaataagaatgccatcagtctgatgaaagagggcgttgtgatcctgaactttgcaagagatgtactggtgaacagtgaagacattgtggatgcacttgttggtggaaaagtcggacgctatgtaactgactttccgacaccggagatcgcaggagtgaagcatgcgattgtcattccgcatctgggagcgtcaactgctgaatcagaagacaattgtgcaaagatggcagtagaagagctgaaggatttcctggaaaatggaaatatccgtaattctgtcaacttcccggcatgcgatatgggtgtaagggataagacaagaattacgatcctgcacaggaatattccgaacatgatcggtcaatttactgcgcttctggcaaaggataatgtcaatatcgatgatatgacgaataagagccgtggcagctatgcatatacgatgatcgatgtggataatgatgtggcagaagacgtggtaaaaggtctggaaatgatcgagggtgttctgaaagtcagagtaattgcataaaaagtgacagagggtgcgtttggaaaagcgcatccttttttgttaaaaaaataggaatcctgttaaatgattaattactgccatttcggtagcatttcaaaaaaaagtgtgttacactcgcaatagattgtggcggactgttattgcaaggaaagaagatacaaagagtatcaatatgtcatatacagggaggtatttaatatggcaataacaatcggcataaacggatttggacgtattggaagagttgcattccgcattgccatcaatcagccggaaaaatttaaaatttgtgggatcaatgtgagaaacgcagatctggattatatgatttatatgatccgttacgattcgatctttggacgtttccagggaagtctggaaaaatatgaggatggaattgttgtaaatggcgagaagatccgagtgtattcagaaaatgatgctgctgacattccgtggggagagtgtggagcagaatacattatagatgcgacaggtgcttactgtacgacagaaaaagcaatggcacatatccggggtggagcaaagaaagtgatcatctctgcaccggctaaagatcaggacacaccgacatttgtaatgggcgtgaatcatgaactttatcagtcatctatgcaggtcgtttcaaatgcatcttgcacaacaaactgtcttgcaccgatctgtaaggttttggaggataattatggaatagagtatggtctgatgtctaccatccattcagctacagcaaaacagaaggtagttgactgccgttcgctgaaagactggcgtacaggtcgtgctgtattcggaaatctgatcccatcttcaacaggagctgcaaaagcaatctcacttgttattccggcgttaaaggaccgtatgaatggaatttcttatcgtgtaccgacttcagatgtatccattgtggatctgaatgtcgcgttgaagacagaaaccacttatgaagatatctgtaagaaaatgaaggaagcttccgaaacaactcttaaggagattctggattatgtggatgatgaagttgtttcttccgattttatcggagataatcacgcatcctcttttgatgcaagggaaggaatccaggtaaacggtcattttttcaaactgatcagtttttatgataatgaatggggatataccagtcagatcttccgcatgatttcgcatatgtacaaggtggaccatggtgtaaaataaaacagattgtaaatgaaaaagtaaaacgtatatcaacagtaacagtcagaagccatgaaagaaagagtatcacgtgaacaagaagaaacgtgatactctttttgttacataggaacattcattctgatttggtattcaaaatttttcaaaatgttttttcaaaggcagaaaatatcgtcttttttataacgatgcttgcgtattttgaaaaatatggtatgataaaggacaaaagtagcactttacagtgtgaaaatgtaacgtaggaggaagagataatggcatacgagattacaggacatacagtccttaccggattactggggagtccggtagcacacagcatttccccaatgatgcataacgaggcatttcgccagctggagctggattacgcatatttggcatttgatgttggaacagataacttaaagacagcagtagatggtctgaaagtcatgggagtcagaggattcaacctgactatgcctgacaagaatctgatgtgctcactggttgataaactttcaccggcatctgagatcggtggggcggtcaacactgttgtaaatgataacggtgtcctgacaggttatacgacagacggaattggattcatgcgtgcagtcagtgagacaggcgttgatatcattggcaagaagatgacacttcttggagcgggtggagccgcagcagcgattctgatccaggcagcacttgacaaagtagcagagatttcggtattcaacatccgtgatgaattcttcacacgtgcggagaagacaatcgagaaacttcatgagaagacagactgcaagatcaacctctatgacttttctgacccggaagccctcaaaaaggagatcgcagaaagtgcaattctggtaaacggaacttctatcggtatggcaccgaagacagacagatgtatcatcacagatgacagtgtgttcagaaaagatctgtttgtatttgatgtaatctacaatccggaagagacgttattcctgaagaaagcaaaagcagcaggatgccggacactgaacggtctgaacatgctgctatatcagggtgctgcatcatttgaactctggacaggaaaagaaatgccggttgatattatcaaagaaaaatatttctcgcgttaatttgctgaaaatgattgacaaagcctattgattcgtgtaacatgagctatagattttaaaaattacatattctactatcaaaatacaatgaaaagaagtagtaaatataataagacgtcacagagagtcctttatcggtggaagaaggataccgaagattatattgaattcctcttggagtaggatactgaatgcattcttttgaagaattgttaataggtatttccggtagcagccgttatctgcaagggtataaccgttatgaacgacgtacctgacgaggcagttgtcgtgagacaattgtaaaatgaggtggaaccacgaagtatataatactctcgtcctctgtttttacagaagacgggggttttttgtttcataggaaattccgaaggaacttctaaaagacatattcgatgattagtagagagaaagggaaaaagattatgattatcgtattaaaaccaagaacaagtgatgaaaacgtaaaacgagttgagaatatggtccgtgccaagggactggaagtacatactgtaaaaggtgaggatcttacaattatcggctgtatcggcgatacggtccgtgtggatccaaagcttttcgaagtagactcttctgttgagaaagttatgcatgtacaggaaccttataaacttgtaaaccgtgcattccatccggacgataccatcgtagatgtatctggtgtcaaagttggtggcggacatctggcactgatcgccggaccttgttctgtggagtcagaagagcaggtgatcgagatcgcaaaggctgttaaggcatccggtgcaaatatgctccgtggtggtgcattcaagccgagaacaagcccatattcattccagggactgggccttgaaggtctggaaatcttatgtgcagcaagagaagagacagggcttccgatcgtaacagagctgatgtcaccggaatatctggaaatcttcgatgaaaaggtagacctgatccagatcggtgcacgtaacatgcagaactatgacctgttaaaacagctcggacagacaaagagaccgatccttttgaagagaggacttaatgcaacttacgaagaatggatgatgtcagcagaatacattatggcatccggaaatccaaatgttatcctctgcgaaagaggaatccgtaccttcgagacttataccagaaatacactggatcttcagtctattccggtagtaagaaaactcagccatcttccggtagttgtagacccgagccacgcaggaggaaaatggtggctggttgatccgatggcaaaagcatcagttgcggcaggagcggacgggctgatcatcgaagtacataacagtccggaaacggcactttgtgacggagcacagtcgctgaaaccggaaaaatatgatacactgttaaaagagattaccggaatcgcaaaagcagtcggtaaagaaatgtaaaaaacagcagcctgggaggaacaaaacgatgaaaatgacggtagatttaaaggaacacagctatccgatctatattgaaagaggaattctgaaagaagcagcagaaagaatagcggaagtgtatcagggatcaaagatcatgatcatttccgatgacagagtttattcttattacggagaagcgcttaagaaaaatctttctgaaaaatatgagtgtgcggaaaccgtgattccacatggagaaccgtcaaaagcattcgaaacccttccgggggtatacagttctcttctggaagcaaagatttccagaacagacctgatcgttgcacttggcggtggagtggtaggagaccttgccggatttgtggcagcgacctttcttagaggaatcaagttcgtacagattccaacttccattcttgcacaggtagattcttctgttggtggaaaagttgcagtcgatcttccgcagggtaagaacctggtaggtgctttttatcagccgaagatggtactgatcgatccggatgtgctggaaaccttgccggatcgttacgtgacggatggcatgggggagattatcaaatacggatgcatcaaagaccgcaagctttttgatcttctggaaaaatgcggatgctatgagaatctgaaagagcatttaactgatgtgatcgcaacctgtgtcgatatcaaacgccgtgttgtggaagaagacgagtttgataccggagagaggattctcctgaacttcggacatacccttgcccacaccattgagcagcacttccactatgaaagagaaagccacggtgaagccgtagccatcggaatgtaccagatcacaaagattgctgaagagaaaggactcaccaaaaaaggcgaagccgagcacatccggaaagtcctggaagcttataaacttccggtaaaagccgatgtcccactcccacagcttaccgaagcaatcaagctggataaaaaaacactgaataataaattaaaagtcgtccttctccatgaaatcggagattcctatacatacccgaccggacaggaattctttgatggggacaggacagtataagtaaatacgataaataagaatgccgtaaaaccatgaaagatattggttttacggcattttagttaaaatgatgcagtattttcaaaataatatgatataaaaaagagcttcttgtttgccagaaaagtaaaaatatactaacaaacagccgcaagagaaccataaaacaggacagattccatttttgtgcaatggagatgagactcaaaaatcgtggaagccattgctgaacacgattttcgctttcagaggctcatcggaatggtttgcacaaaggaagctgtcctgttttatggttcttttgcggcgtctgttcgctaatatatccttactatcccgccaacaaaatttatctcatatttctcttcgcaagcaaatcatgaatcttatccgtcggattcataaccgcactaatagatgtagaatgattcatcgaatcaatgatcagtgcaaggaacttactcatatctgcttcaatgaaatacggtttatcatgaagctgaggaggcagataggtcagattggttgtgatcagtctgtccagatagcccttttcataatattcatcgaacttgtcaagaccttctgtgaagagaccaaaagtagtacatacaaatacacgctcagcaccgcggtcttttaactgcctggtaacatccagcatactttcaccggaagaaatcatgtcatcgatgatgataacggtctttccatgtacatcgtcacctaagaattcatgtgcaacgatcggatttttaccatttacgatggtagaataatcacggcgtttgtagaacatacccatatcaacaccgagtacgttggagaagtatacggctctttgcattgcaccttcatccgggctgatgatcatcagatggtctttgtctgctttcagatccggttctgctttaaacagagctttgatgaactgatacagagggttgaagctgtcgaaaccattgagtgggatcgcattctgtacacgcggatcgtgtgcgtcaaatgtcagaatgttagatacacccattgcggttaattcttccagagccattgcacagtccagagattcgcgtttggttctcttgtgctggcggctttcgtaaaggaatggcataattacatttacacggtgtgcctttcctgtagaagcggagatgatacgcttcagatcctgatagtgatcatccggtgacatatgattgatatgtccgtttactgtgtatgtcaggctgtagttgcagacatccaccataataaagagatcttttccgcggatactttcgccaaacattccctttgcttcccccgaaccaaaacgtgggcaactgttctttgcaagataagaatctgcttcataagatgaatagattgcaggatccagaaaatcatgcagagaatttttgcggaacgatacgatgtactgatccactttttctgccagatccttgcagctttccagggcagcaattttaagtggtgctgtcggaagagctttttccataagttcgatatttgtcatgagtgcctccttataataagcgttttaagtgctttttatctaatcttacttatcttttataccattatttaaaagcaatgacaagaaagaggcgttaaaaaattgcattttttgaagaaatctagtatgatatagaagcagaattccgaataaatatcaggaggaagaaaatatgagtaaaccagttgttgccattgtagggcggccgaacgttggaaagtcgacgctttttaatgcactggcaggagaaaagatagcaatcgttaaagatacgccgggtgttacccgcgacagaatttatgcagaagtgaattggctcgataaagaatttacgttgatcgataccggtggaatcgagccggacagccgtgatgtgatcctctcccagatgagagagcaggcacagatcgccattgacactgcagatgtgatcctgtttatgacagatgtaaagcagggacttgtagattccgattcaaaagtggcagatatgctccgccgctcccacaagccagtcatccttgttgtcaataaagtggacaattttaacaagatgatgccggatgtgtatgaattttataatctgggaatcggagatccggttccaatctcagcatcggaacgaattggaatcggagatatgctggataaggttctggcatattttccggaaggggcaggccaggaagaggaagatgaccgtccgagagttgcaatcgttgggaagccgaacgttgggaagtcttcgatcatcaaccgtctgatcggaaaagaccgtgtgatcgtatccgatattgccggaactacaagagatgccattgacacggaagtagtgcacaatggaaaagagtatgtattcattgatacagcaggacttcgccgtaagaataagatcaaagaggaactggagcgctacagtattattcgtacagttacggcagtagaaagagcggatgtggtcctggttgtgatcgatgcggcagaaggagtaactgagcaggatgccaagatcgcaggaatcgcacatgagcgtggaaaaggtgtcatcatcgttgtaaataaatgggatgccattgaaaagaacgataagaccacgagggaatatgagcatcagatcaggatggtgctgtctttcctgccttacgcagagatcatgtatgtgtctgcactgacaggtcagagacttccgaagctctttgacatgatcgacaccgttattgagaaccagacactccgtgtggctacgggtgtccttaacgagatcatgaccgaagctgttgcaatgcagcagccgccgtcagataagggaaaacggctgaaactttactatattacccaggtagcggtcaaaccgccgacatttgtcatctttgtaaatgataaagaactgatgcatttctcttatacgagatatctggagaataagatccgtgaagcgtttggcttccgtggaacgtctcttaaattctttatcagggagagaaaggagaaggacaaataagatggaacgtcttgtatgtttgctgatcggctatatatttggtctgtttcagaccggctatttctatggaaaaactcagggggtagatatccgcaagatgggaagcggaaatgcaggttctaccaatgcacttcgcaccatgggaatcaaagccggaatgatcaccctgctaggtgactgcttcaaatgcgtgatcgcagttctggtggtccgcggaatttacggacagtctcacgcagatattttaccgctcctttcgctgtatacaggttttggggcagtgctcggacataattttccattctatctgaagttcaagggcggaaagggaattgcagttacggcaggtatgatcttatctacagatattcggattgcggcagtatgtttgatcgtgtttatcgtaattgttgccgtgacacgttatgtatcactgggatcgctggtgatttccgtactgttccttgtcggactcgtcgttgacggacagatgggaatgtttggaatggcgcagaagtatctgtttgaaatgtatggaatcggagcactttttgttctctctgcatttatccgtcaccgtgcgaatatcggacgtctgagaaatggtacagagagcaagatcagtttttcaaaaaagaaaaataagaggtaataatttatggcagaaatcggagttatcggttcaggaagctggggaacggctctggccctggtactgaataaaaacggacatcatgtaaccatctggtcttatttaaaagaagaagcagatgagatcagaaaaaagcgggaaaatccaagtaagcttccgggcgttcatatcccggaggagatcgagatcacaacagatctgcagggaagtgtggaaggaaaagatgtggtcgttcttgcagttccgtctatggcaaccagagctacggcgaagaaaatgtgcccgtatgtaaaggaagagcaaattctggtcaatgtggcaaaaggaattgaagagggtactttaaagacgctttctgagcagattgaagaagagattccgcaggcaaatgtagctgttctttctggtccaagtcacgcagaagaagtaagccgcgaacttccgacaacggttgtagtcggagcagagacagaagaaaccgccatttatctgcagaaaattttcatgaatgatgtattccgtgtctacacaagcccggatattaaaggaattgagcttggcggttccctgaaaaatgtaatcgcacttgcagccggagttgcagatggactaggatacggggataacaccaaagctgcactgatcaccagaggaattgcggagatcacaagacttggtgtaaagatgggcggaaagctggaatcctttaccggacttaccggaatcggtgatctgatcgtcacctgtgcaagtaagcacagtcgtaaccgtaaagcaggtgttctgatcggtgagggaatgacgatggaagaagcgatggctgaggtcaagatggtagttgagggtgtgtattcagcaaaagcggcaagagagctggctgaaaaatatgaggtatccatgccgatcgtggaaaaggtcaatcaggtactttttgaaggcaaacccgcaaaggatgcggtaagtgaactgatgatgcgtgacgggcgcagcgaatacagtaaccttccgtgggattaaagtttcaaagaaatttcataaagtcttaatggaaaatccttccgtataggcgtataatgacgtgtatacaggaggattttttgtatgaaattcggaaaaaaagaaaaagaaacacaagaggaagaagtcgttcgcggcgagatccagcgtgtggttccagactaccgggtaggtcttaatcccgagcagattcggataagggaagagaatggctggaccaatgatgaggttgctccaccgggacttacgacaaaagagattgttcataataatatatttacctatttcaacctgatctttctgattctggcgattctgctgtgcctggtaggttcttttcgaaatctgacattcctgccggttatcatctgtaatacactgatcgggatcattcaggagatccgttccaagaaagtactggataggctgaccatgctgaatgcaccgcacgcagaagtaatccgtggaggggtatcgctgaatctggaggcggatcagctggttgcggacgacattgttgtatttcgtgcagggaaccagatctgtgcagatgcggttgttgaggctggtgaggttcaggtcaatgaatctttacttaccggtgaatctgatgagatcacgaaaaagcgtggagaccgtctgatgtcaggtagttttgtggtatcaggaagctgtcatgcacgcctggacaaggttggagcggattcctatatttcacagctgactctggaagcaaaagccatgcagcagggggaacagtcggagatgatccgttccctggacaagctggtaaaaatggtcggaatcgcactgatcccgataggaatcattttgtttgtgcagagttatttctataatcacgacagcttccggcagagtattatctccatggttgctgcagtgatcggcatgatcccggaaggattatatcttcttgcaagcgtggcacttgcggtaagcgcaatgcgtcttgcatcgaaaaaggtattgctccatgatatgaagagtatcgagactctggcgcgggttaatgtgctttgtgttgacaagacaggtacgatcacagaagacagtatgtgtgtcagtgaagtggtgaaagccaaggcctatgacgaagaaaagatgccggatctgaaccggatgatcggcgattttgtcaaaggaatggacgcggataacagcacgatgcatgcgatgcaagaacattttacagagcattcagataaagtgccggaaaaagtgattcctttttcttccacggtcaaatacagcggagtaattttcaaagatcaggcatatgtgcttggtgcaccggaatttgtcctgcgtgaggattatacaaagtatcagggaagaatagaacagtatacgtccagggggttccgtgtactggtatttggaagctatgatggagagccggatggtaagccgctgactggaacggtaacgccgcttggttatgtcctccttctcaataaagtcagggaagaagcgcctgcgactttcaaatattttgcggaccagggtgttgcgataaaagttatttcgggtgataatccgatcaccgtatcggagactgcgaagcaggccggaattgaaggcgcagagaattacgtggatgcgggaacattaaagaccgaagaagatattgcccttgcggtgagcaaatatacggtcttcggaagggtaatcccggaacagaaaagacagtttgtgcaggcactgaaaaagcagggaatgacggtcgctatgaccggtgatggtgttaatgatgtacttgccctgaaggatgcagactgttcggtggcgatggcatcaggaagcgatgcggcggtccaggcgtcccaggtggtacttctggaatccgatttttcaaggatgccggaggttgttctggaaggaagaagagttgtcaataacattcagcgttcagcaagtctgttcctggtgaagaatattttttccttcctgcttgcaattttctcggcagtctttatgattacctatccgctggagccatcccaggtatcgctgatcagcatgtatacgatcggtattccggcattcttcctggcactgcagccgaaccgggatatcattaagggacacttcctgaccaatgtgttcttaaaggcacttccggcaggacttacggatgtatttgcggttggtgcgctggttgtatttggacagacgttcggagttgcatccaaagatatttctacggcggcgacgatgctgctcgcaattgtcggattcatgatcctttaccggatctgccagccgatgaatgcactgcgtatgatcgtctggatcggatgcgtgatcggactgttaggatgcagtatcttcctgccacagttatttgcgattacgggaatgtccagaaaatgcattatgctttttgtaatattctctattgcgaccgagccggtccttcggtatctgacgaagctgatcaaatggctgagaaagcagtacataaaatttatcaagaatccactcaaagaatttaaaggaaaagctgccgattaaggcagcttttcttggaaaatgagtatttttaaagaataaggatcagataattcagtctgcaaattttgcattctgatccacttcttccgactggtttacgatatgattggtcaatgcctcatcatccgtggtaaacacaatatccggcagaagttcaaaataaaaatccgtatattttttcgcaagagcctggatacagaaattctgtacgatcttaaaccgggtaatggaaaccagatctttgtcaaaggtgatgtaaacactgatccagagctttcttccggtacggagaatgtcatagtagagctttttgtaaccataggcatttaggacaggttcgatcgtttctttaatttcatcaacagtctcttcctccggcgggatcaggaacagatcccgaagtccggttattaccgtctttatcggtgtcggcagcataaagatggacagggtgacggtaatgatctggtcaagataaggtgttatgggtctgaaccatggaaaaggcagcagaaccggaagaaagaaggcaattgccataccgaaagaggcaatactgtcgatctcccagccttccatttccattgtgatcattggggaatccatcagacgattcttatatttgagataaatggatacggtaattcccagaaaaaatgcaaataattcaaaccaggcaatggtatcaaaagcgacttttctgccaccatggatcatgatttcgatattgttcaggatcagcccgacggtaacgccagtcatggtaatgcccttgacaacgacaaacatagattcaatctgcatataaccgaacgggtgcttttcattggatggcttgtaaagtagcggaatcagaaaaagcgacggcaggagcatgcagaactcgactccgtcatagattgcgtccagaagaactgcctgggaactggtgtagattgccatgacgatctcaacgataacgaaaaacagattcccgtacagggagacagacatggcttttttttctcttttttgtgcttttcttcctacgtgcataggatacctccttttttgactgtaagaaaatcccgataggattttctgataaatgaaaggcattacgtgcctgtaatacgcttttttgttaccatttatcatacccgattttgaaattgatggcaagaaagtaaaagtgaactggcagtatagttgttctaaaccggggaaagcccgcatacactgtatcagcaatcaaagggggacagtgtatggatacatttgatttatacaaggatatacagtgccggacgaatggagagatctatctgggtgtagtaggaccggtacggagtggcaaatcaacctttatcaagcgttttatggatgtgctggtgctgccgaaaatgaccgatgagcatgcaaaagagcggacggtggatgagcttccgcagtctgcgtcagggaagagcatcatgacaacggagccgaaatttgtgccaaaagaagctgccgaaatccagctcgcaaaggatgtgagtgtgctggtgcgtctgatcgattgtgtgggctatatggtggagggagccgctggtcacatggaaaatggagcagaacgtctggtgaaaacaccgtggaacgaaaaagaaattccgtttacaaaggcggcagaaatcgggacgaaaaaggtaatccatgaccactccacgatcgggattgttgtgacgacagacggaagtatcggagagcttcccagaaacagctaccgggcggcagaaaagaaaacgatccaggagctgaaaagcattggaaagccgttcgtggtcttggtcaatacccggaaaccgtacagcgcagaggcaaaaaacgtggcagaagaaatccagaaagaatatcaggtaacggcacttccggtcaactgtgaacagctacgggaagaagatatccaccgaatcatggaaaatgtgctctttgcatttccggtcacagaagtaaaatttttccttccaaaatgggtggaaatacttacagcagatcacaaggtccgggaagagctggtatcttatgcaagagaagtcatgggcagaatcggagaaatccgggatgcgatggagatccggaagccggagcagagtacctacataaatgcagtaaatgtaacaggtgtgtccatggataccggtgagatctcggttgaaatcaaggtggaagatggctgttattatgaaatgttaagtgatctgaccggaacgcagatcagcggggaatatgatctgatccatacagtgcgtaatcttgccatgctccagaaagaatatgaaagtgtcaaagatgcacttgcttcggttaaaatgaaaggctacggtgtagtcagcgcgacaagagaagaaatccggctggacgatccagtggtaatccggcagggcaataaatacggagtaaagatccgttcggaagcaccttctatccatatgatccgagctaacattgagaccgagatcgcaccgatcgtggggagtgagcagcaggcaaaggatctggtaaattatatcaacgaggcggcaaagagcccggatggagtctggggaaccaatattttcggaaaatcgatcgaagagctggtgatggatggcgtgcgaaacaagatcgccatgatcggagatgagagtcaggcaaaactgcaggacaccatgcagaagatcgtcaatgacagcaacggaggtatggtttgcatcattatctaaaatttttcttaaatcaattcgattggcggcaggaaacttgcatggcaatccgagagtatgttatactaaagtctatacgttaggggatacattttcatggaatgaatggtcatataagataccatgaaatctatacgtgaggagaaaagaaaagagggacatctatgaaagtagcaattgtatcagcagacaccatgatatacagaaaacagaaggatgatacgtgttcgccaatcgtgcgaagagtgctcgatcaggtcagcttcaagacagagcttgtacagccggtaccaaatgacagggaggttatccgcaagatccttgcgaagatcgcggatgcacagatggcagatctgatccttacgatcggtgggatcggatgcagagaagaggactgtgttccggaagcgacaaaggcagtggtcgataaggagattccggggatcggagagtcgatgcgtctttttatgacacggaccagaaaaagggcaatgctgacgagaggaacagcaggtatccggggtaaatccctgatcgtcaatcttccgggaagtccgaagatcattaaagagtgtctggaatatgttcttccggagattgtttatgcaacagagacggcagtcggtgaacatgatgatgttgaggagtagacagacagatgagggtgacgtatatcggacacagcggattttcggtggaactggaatcccatattctattatttgactattatgaaggaacgatgccagagtttgatccagcgaagaagctgttggtgtttgccagccattcccatccagatcattttaacagagagatcctgaagcttgcggatgtgtatccgaatgtggaatatattttcccgaaggatatcagaattgcgaaaaaggagcagcgtgaatcggaacatttcatgcgaaaaagggatgagattactgtcggggatacaaaggtaaaaagtctgcgctcaaccgatgaaggggttgcctttctggtaagatgcgaagacaggatcatttatcatgcaggggatctgaactggtggcactgggaagaggaagatgatgcgtataaccggatgatgcgcggcgattatcaaaaggagattgaaacgctggctggtgaaaagatcgatcttgcatttgtcgtgcttgacccgagacaggaagagcagttttactggggctttgactggtatatgcggcatacggatacgaagattgtatttccgatgcatatgtggaagcagtacgaggtgcaggatcggcttatcggaatggaagtatcagaaccataccgggagaagatcatgcggatccgggaaatgggacaggtatttgaactataaggagacaagttatgaaagtcagtatttatacagatggagcggcaagaggtaatccggacggaccgggcggttatggagtcgttctggaatatgtagacccgaagggagaacttcacgttaaagagctttccggcggctatgtgcggacaaccaataaccggatggagctgatggctgtcatccgggggctggaagcgctcaacagaccttgcgaggtagagctttattctgattcccaatatgtggtcaatgcattcaatcagcactggattgagggatggatcaaaaagggctggaagcgtgggaagaatgagccggtcaagaataccgacctgtggaagcgtcttctggaagcgaaaaagccgcaccaggtgaacttcaattgggtaaaagggcatgatggacacccgcagaatgaacgttgtgatactcttgcgacaacggcagcagacggaaatgagctgcaggttgatccgggggtgtagaagaaatcctttacactgataaaaaaatgtgataaagtatctaaggcaagtaagacagacgttcgcggatgcaggtgccgaaaggccgcagacgaggaaagtccgggcttcacagggcaggatgccggataacgtccggtagaggtgactctaaggatagtgcaacagaaatataccgcctgcagatgcaggtaaggttggaagggcagtgtaagagactaccgcctgggtggtaacacacagggcatatgtaaaccccatccgaagcaagaccgaaaagaagtggtatggcggcccgtcatgcttcaggttggtcgcttgagtctgctggcaacagcagaactggatagatgaacgtccacgacataacccggcttatcgttttgcttgcttttttatttttaattgagaaattttgaaaagaatctgtattcatattcatgaaggatatagattctttttttgttgcggtgtcctttaaaaaactttaatttttatgatatcgtagtattgtgtgaatgattttttgagtggaatgaaaaataaaaaaacgtgataatccgtttgacaatcgtttgaaaaatatggtagttttaggaggattaaagttatgtaggagtgtcaaatgaggaatgatcgttttcaaagtcgggaaagaggaaatgtagcatattaccatcttccgggcttgtttgaattttatgaactgtacagactttttttgccgctgttttatacacacagggagtatttctatgactggtgtgagattggttccatttatggagccccggaagactgcctgtggggcggaggacgtgtggaagcaggagaagcagagacggaagaagtgcttgcacttatgcagaagtacgggatttctgcccgtctgacctttagtaattctctgctcaggaaagagcaccttgcggatcagagatgcaatatgctttgtcagttatttgagaaaagcacaggtgtgaaaaacggtgtgatcgtacactcagagctgctggtggattatctgaaaaagaagtatccggggttctatctggtctcatctaccacgaaagtgttgaccgaatttcaggagtgtctgcgggaaatccagagagaagattttcaatatgtcgtgccggatttccgtctgaataagatgttggataaatggaatacattatcagaaggtcagaaggataaagttgaattcctgtgtaatgagtgttgttggttcggctgcagggaccggaaagcctgttatgaggatgtgagccggaagaatcttggagaagatggagaggaacaccggtgtactgcgccaaatgcaaaggaaggctatcgtttttcaaaagcaatgacaaatccgggatttatcagtgtagatgatatcaaaaatatctatttgccgatgggatttacaaattttaagatcgaaggcaggggacttggaagtgcgctgatcctggaatttctgctgtattatatgacaaagccggaatatcagttgcatgtaagagagaaattgtatctggataatatgctggatttgttttaaaatcaagggaaagatttttatggacaaataccagaaatttcgaagacatattcgcttttgtttttctgcgtctataggaggtattttttatgttattaagtattgcgctgatcctgcttgttggaatgtgtatgagttggatctgtcaggactgaagaaaataggaagatccgcagtgatgatgtgctttgtccctgcaagcctatgactgcattctgtcaatatccactgtatgctatgccggacaaacatactgcagaaaacaggacgagcaataccaagatctcctttcttactgtacgaaggagacaaaaaataaaggacgcatgaaaaaattttcttttttcatgcgtcctttgcgtggcacctgtccgcctagtccaacaagccgacgctagccccgctttctgttgtatttctcttcacagtatttacatctatacacttcgttctccggatcagtcagtacaaacacatgatccagtccctgttcaatcgaagtaatacatctcggattgtggcatctgatcacattcttgatttcagatggcagtttcagttcttttttctcaacaatcttggaatcttcgataatgtttaccgtgatattatgatcgataaaaccaaggatatccagatcaatgatattgatcgggcattcaatcttgatgatatcctttttacccatcttgttacttttggcattcttgatgatggctacgcagcagtcaagctgatcaagtttcagatatttgtagatatccatgctttttcctgctttgatgtgatccagtacgaagccctctgaaattttcccaatgttcagtgtattttcaaccatgtctttcgcctcccttaatctacatgaatatccaaaagtgtcaggatcagtgccatacggatatagacaccatactgtacctgcttgaaataaacagctcttggatcatcatcaacttcaacagaaatttcgttgacacgcggaagtggatggagaaccagcatatcttttggtgcaagttccattttccctttgtccaggatgtagaaatctttcatacggatataatcttcctcgttgaagaaacgttccttctgaacacgtgtcatataaaggatatcgagatccggaagggcatcctccaggcgttctacttctgtatatgggatatttttcttatccagtacgtctttgcgtacataacctggcagacggagttcctccggtgaaataagtacaaactcgatgttctcataacgcaccagggcattgatcagagaatgtacggtacgaccgaatttgagatctccacagagtccgatcttcagattattcagacgtccttttaaagaacggatggttaaaaggtcagtcagtgtctgtgtaggatgctgatgtccgccatcacctgcgttgatcaccgggattgaagagtactgtgctgcaaccatcggtgcaccttcttttggatgtctgatcgcacagatatctgcatagcaggaaaccatacggatcgtatctgctacgctttcccctttggtagcagagctggaagctgccgaagaaaagccaagtacattaccaccgagattcatcattgctgcttcatgactcagtcgggtacgggtacttggctcatagaataaagtggcaagctttttgcctgcgcaggcgtgtgcatatttttccggatgagcttcgatatcacctgcaagatccataagctggtcgagctcttccacagaaaaatctaaaggactcattaaatgtctcataagaaacctccttaaaaataaccgcagaatatgtgcgggttcatatattctttatctataatataacaaaaacatggttatttcaacaaagttttacatgttttttctgatcgggtttgcgaagaaatgtagattttacagaaaaaatatattataatgaaaaattagtaacgtcagcgtaagaagacataaggataaaacgataaggagtgggacaatgcagagtctggaagagatgagaaaagagctggatgtgatcgatgaccagatcaccacgctttatgagagacgtatgaaggtctgcgaaggagttgcagaatataagataaagaacggacgaaaagtatttgataagacaagagagaacgagaaactggcagcagtagcggaaaaggtgtccacagattttaacaaaaaaggaatccgggagctttttgaacagctgatgagcatgagcagaaagctgcagtaccagcgtctttctgaggaaggagttctgggaagacttccctttatcggactggatcggctggatcttgatggtgcacgtgtggttttccagggagtggaaggagccaacaatcaggcagctatgttaaaatattttgggaaaaatgtgaaaaacttccatgtaccgtcattccgtgatgcaatggaagcaattgaagagggaagcgcagattatgcagtccttccaattgaaaattcttccgcaggtccggtgacacaggtgtatgaccttctggtggaatttgaaaattacattgtaggagagacggtccttccgattaagcatatgcttgccggagtgaaaggaactacactttccagcattgaaagagtgtattcacatccacaaggactgatgcagacatcccatttcctggatgaacacggaacctggcagcagatcagtgttgccaatacttctatggcggccaagaagatgatggaagaccaggataccacgcaggcagctgtctgcaacgaatatgcagcagagctttacggactggatatcctggcaagagagatcaatgacgaatctgacaacagtacaagatttatcattgtcacgaaccagaaggtattcctgaaaaatgcatccaagatcagtatttgctttgaaataccgcatgagagtggatcgttgtaccatctgctttcccattttatttacaatgacctgaacatgacaaagatcgaatcccggccggtagaaggaaaaagctgggaatatcgtttctttgtggactttgaaggaaatctggcagatgccgcagtgaaaaatgcgatccgtggactgagggaagaagcactgaatctgaaaatccttggaaattattagactgaaaaagagaggacacggctatgagaacaaatgaactgatattatatcgttatatggaacatgaagatctgcttcgggacatgacatttctgatcgacaatgcagataatgattattacaacaaagaggatttgaagagccttcttttcgaaaatttaaatgagctgatcgagctggctgcaaactatggattcgaggggcacctctggcataccttcctgacgttcctgcttgccaacagtgagaatgcttacagcacagcctgtgaagtggtaggcgaggtagagggaagcgtcaataaagcagcccttcatgattttcagattttcaaagaactgttcgaatatgatctgaaagagatgggtaaaaagctcggtacagacagtctggaactgattgaggactatcatccggtcaatgccaagggacatgtatttaacaagaggattcgcgaccggatctgcgacttaagcaaagctcttgcgcagacagatgatgcagaagaatttaagacaactgtaacccagttctacaaagaattcggagtgggaactttcggacttcacaaggcattccgtattgagcatacggaagaaggagcacagatcgtgccgatcaccaagatcgcacacgtccatctggatgatttggtgggttatgacattgccaagaagaaactgatcgataataccgaggcatttgtaaagggtaaaaaagctaataattgtctgctttttggtgatgccggaaccggtaaatcttcttcgatcaaggcaatcctgaaccagtattatgaccagggacttcgtatgatcgaagtgtacaagcatcagttcaaagacctgaatgatgtgatcgcacagatcaagaaccggaattacaaatttattatttatatggatgatctttcttttgaagaattcgagattgagtacaaatatctgaaagcggtgatcgaaggcggtctggagaagaaaccggataatatcctgatctatgcaacttccaacagaagacatctggtacgtgagacattcaaagataaagctgacagagatgaagaactgcataccaatgataccgtacaggagaaactttcgctggtagcaagattcggcgtgaccatttattttggaaaaccggataaaaaagaattccagaagattgtcaccacgcttgcagatcgttacggtgtcgagatggaagaggaaaagcttcttctggaggcaaacaaatgggaattgagccatggtggattaagcggacgtactgcacagcagtttattgattatttgcttggacaacaataaaaggagaaccaatatgaagtggaataaattcagattaaagacaacaaccgaggcagaagacattgtcagtagtatgctgatggaccttggtgtacagggaatcgagattgaggataagattccgatgacacaggcggaaaaagagcagatgtttgttgatatccttccggagacaggaatcaatgacggcatcgcatatatcagtttctatctggaagaagatgaagataaagaaagtcttctggaagctgtgaaaaatgaactggaagatatgcgtgcctatgtggaagtaggtgaaggaacgatagaagaatcccagacagaggatgtggactgggtcaataactggaaaaaatattttcaccagttctatgtggatgatatcctgatcattccgtcctgggaagaagtaaagccggaagatgaaggcaagatgatcgtgcatatcgatccgggaactgcattcggaacgggaatgcatgagaccacacagctctgcatccgtcagctccgcaaatatgtgacagaggacaccagaattctggatgtaggatgcggaagtggaattcttggaatgctggcgttgatgttcggtgcaaagtattctgtaggaacagacctggatccgtgtgcgattgatgcaacctatgaaaatatggaagtcaacggtatttcaaaggataaatacgaagtaatgatcggaaatatcattgatgataaggaggtccaggataaagttggttatggatgctatgatatcgttgtggcgaatattcttgcagacgtactggtgccgctgacaccggtgatcgtgaaccagttaaaagatggtggtatctacgtgacaagtggtatcatcgaagacaaggaggagacggtaaaagcagcggtagaggcagcaggactcacggtcctggaggttcatcatcagggagaatgggtatctgtaacagcgagaaaagaaacgaaagcgtaggcagagaggatcagaaaagatgcatcatttttttgtaacaccacagcagatctccggagataagatccggattgaaggcggagatgttaatcatatgaagaatgtgctccggatgaagctgcatgaaaaggctgaaatcagtgacggagaaagcagaacctatctgtgcgaggtggaagcctatgaagaagatgtggcggttctgcatattctggaagagatggaagcggacacggaaccggcgtcaaagctgtatcttttccaggggcttcccaaaagcgacaagatggagctgatcgtacaaaaagcggtggagcttggcgtgtatcaggtgattcctgtagcgatgaagcgttctgttgttcgtctggatgataagaaagcaacgaaaaaagcagaccgttggaattccatcgcagaaagtgcggcaaagcaggccggaagaagccggatcccggaagttaccatgccgctttcttataaagaagcactgaaaatggcagaagagcttgatgtgacgttgcttccgtatgaacttgcaggtggtatggaagtaacaagagaagtgatccgccagattaaaagtggacagtctgttgggatttttatcggaccagagggtggatttgaaccggaagaagttgatgcagcagtcagtatgggggcgaaggtcatcaccctgggcaggcggatcctgcggacagagacagccggacttgcaacgcttgctgtactgatgtttgaactggaacagtagaccggcaggcaaagaactgcataagataaagagaagaagtgtttgggagacaaagaaaaatggaagtttatctggataattcagcaacaacgagagcctatgagtgtgttcgggatatagtcggaaaagtgatgtgtgaggattacggcaatccatcctccatgcataaaaaaggtgtggatgcagaagcgtatgtccgtgaggcgaaggagacacttgcaaagattctgaaggtgcaggaaaaggaactttatttcacatccggtggaacagaaagtgacaaccttgcattgatcggaggtgcacgtgccaatcaccgtgccggcaagcatctgatcaccagttcaattgaacatccggcaattctcaataccatgcgttacctggaagaggaggagggttatcgtgtgacctatcttccggttgacgagtatggacggatccgcctggatgcgttaaaggaagcgctctgtgacgagacgatcctggtatcggtcatgtatgtgaataacgaagtgggatcggttcagccgattgcagaagcatctgcgatcgtaaaggcttataataaaaatatcctgttccatgtggatgcagtacagggatttggaaaatataagatttacccgaaaaagatgggaatcgatatgctttctgtaagcggacataagatccatggaccgaagggaatcggttttatctatatcaatgaaaaagcaaaagtaaaaccgatcattttcggaggcgagcagcagaaaaacatgcgttccggaacagaaaatgtaccggggattgcaggaatcgggctggcagcaaagacgatttacacagacctggatgaaaaggtggcacatatgcgtgccttgaaacagcactttatcgaaggggtacagaaaatcgatcatactgtgatccacggactttatgatgaaacaagtgcaccacatatcatcagtgtgggatttgcaggaatccggagtgaggttcttcttcatacactggaagagaagggaatttatgtatcatccggttcggcatgtgcatccaaccatccggcgatcagcggagtgctaaagggaatcggagccggaaaagaatatctggacgcaacgctcagattcagtatgtcagaatttactacagaagaagaaattgactatacgctggaaacattatataattgtgtaccgatgcttagaaagtacacacgccattaggaggaaagaatgaagtttcagacttatttgataaaatatggagaaattggaatcaagggaaagaaccgctatatgttcgaggatgcgctggtaagacagatcaagcattcattaaaggacctggatggattattccatacttataaagcacagggaagagtttatgtggactgtgacggagattatgacggagatgaagtggtagaagctctgaaaagagtattcggaattgtagggatctgtccggttgtccgtgtagaggataaaggatttgaagaactgaaaaaagatgtgatcgcatacatggatgaggtttatccggataagaatatcacatttaaggtagagtcccgtcgtgcaaagaaaacctatccgaagaaatcaatggagatcaattatgacctcggagaagctattctgtatgcattcccggaaatccgggtagatgtacaccacccggatgtactgcttcatgtagaggtaagagaagagatttatatctattccgagatcattccgggacctggcggtatgccgatcgggactaatggaaccgcgatgcttctgctttccggtggaatcgacagtccggttgcaggttatatgatctccaaacgtggcgtcggactggaggcaacctatttccatgcaccgccgtacaccagcgagagggccaaacagaaggtagtggatcttgcaaagcaggtttccaaatatacaggaccgatcaagctgcatgtagtcaactttaccgatatccagctttatatctatgaaaaatgcccacatgatgaactgacgatcatcatgcgccgttatatgatgcggattgcagagcattttgcaaaagaagacggatgcctgggacttattaccggtgaaagtatcggacaggtggcaagccagaccatgcagagcctgatggcaaccaacgatgtatgtacattgccggtatatcggccgctgatcggatttgacaagcaggagatcgtagatatttcagagaagatcggaacctatgagacttccattcttccatacgaagactgttgtacgatcttcgtggcaaaacatccggtaaccaaaccgaatgtagaagtgatccgcaaatcagaagaaaacttaagtgaaaagattgatgaactgtttgcagaagcagtgaatactgtggagacgatcatcgtaaaataataaaagaaaaaggggagctttttcaggctctcctcaaaaaaagaaaggacgcagtacagaaaatgtactgcgtcctgatacttcacattctattatactaagtatggtttcagaagttcgatgatgttatcagcatcctggttctcagcatggatgttcagatcgatcggtttagaaagatcaagactgaagatacccatgatagattttgcatcaatcacatatcttccggataccaggtcaaaatcgtaatcgtattttgtgatttcgtttacgaatgattttactttgtcgatagaatttaaagaaatttgtacggttttcattgaaaacacacctccttgatttcattttctatagttatattaaaagttatacataaaaaagtcaaggaacaaaacgccgaagaatgaatgaaattttcgttaaatgttataaatattgaaagtaggatgaatttatgaaaaaagcagcattacacaacctgggctgtaaggtaaatgcttatgaaacagaagcgatgcaggaactgctggaaaagaacggatatgagatcgtaccgtttcatgatctggcagatgtctatgtgatcaatacctgctcggtgacgaatatggcagaccgcaagtccagacagatgatccatcgtgcccgaaaacagaatcctgatgcagtgatcgtagcggccggctgttatgtgcaggcgcaggcggatatgggtgagctggatgagaatatagatattgtaatcgggaataataaaaaaaaggatctgatccgccttctggaagaatattttaaagaagacattccggaacagatgcaggaggtcattgacattaaccataccttcgagtatgagagcctccatctttcccggacagcagagcatacaagggcatatctgaaagtgcaggatggctgcaaccagttctgtacctactgcatcattccttatgcgagaggacgcgtgcgcagcaggaaaaaggaagatgtagtggaagaggtgcgtacacttgcggaacatgggtatcaggaagtggtgcttaccggaatccatctcagttcttacggattggaatggaaagatgaaaatggaaagcagacagaaggactcctggatctgatccgcgcggtacatggagttgaagggatcaaaaggatccgtctgggttctctggaaccgcgtatcgtgacggaagaatttgcaaaagaactggcttgcctgccgaagatatgtccgcattttcacctgtctctgcagagcggatgtgatgcaaccctgaaacggatgaaccgcagatatgatgcggcagaatatcgggaaaaatgtgagcttctccggaagtattttgaaaatccggcactgacaaccgatgtgatcgtaggattcccgcaggaatcagaggaagaatttgaagcctcccgggactttgtagacagcatcaatttttatgagactcatatatttaagtattcaaagcgccagggaacgaaggctgcgaagatggacgggcagatcccggaacatgaaaaaacgcgaagaagcaatatcatgctggaactgaaccgtaaaaaaatgcagcgctatgaagaaggatggcttggaaaaaaggtggaagttctatttgaagagatgacagaacgtgatgggaaaaattatgtcacagggcacaccaaggaatatctgcggattggggttccatgcgaaccggaacaggcagaccggtggatcaatcagttaaaagagatagaacttacttcactttcacaaattatgcattgaatttttgtatagattatattaaaatgaatatgaagtattggaggtcgtaagatgaaagatataacgaatacacaattttttcaggtagagacaggaccacagatccaggcaaaagatattctggaaattgtatataatgctctggtggaaaaaggatataatccggtgaatcagattgtaggatacattatgtccggtgatcctacatacattaccagctataacggagcaagaagccttgtgatgaaggttgagcgggatgagatagtagaagaattattaaaagcttatatcagacatgaactgtaggttgaagatatgatgcggataatgggacttgattatggtacgaagaccgtaggtgttgctgtaagtgatcctctggggattacggcacaggcagtggagacggttacgaggaaggacgagaacaagcttcggaagacactggcaaggattgagagccttgcaaccgaatatggagtagagaagtttgtgatcggttttccgaaacatatgaataatgatatcggagaacgggcagagaaggcactggaatttggagagatgctgaagcggcgtaccggcattgagatcgtgatgtgggatgagcgccttacaacggtggaagcggaacggacacttatggaatccggcgtaagacgggagaaccgcaagcagtatgtggatcaaatcgcggctgtatttatattgcagggatatctggactctctgggtatgcaaaagtaacaggctttggaatacaatcagacgataaggggaaagtatatgaagaatgaaaaattaacgtttacatgcggagaaggcggcgaagcagaagaattttttgttgtggagcagaccagactgaatggagtgacttaccttctggttgcagattcagaagaggatgatgcagagtgcctgatcttgaaggatacaagtacgccggaagagaaggacagcgtttatgagatggtagaagaggaagtagagcttaatgccgtactcaaggtgttcgaagagcttctggaggatgtggagattgaagtgtagacggaactgtcaaaagaatatttctgacagataagaacggggttcgcacacagaggcggactccgaattttacgataattaaatgtacggatgagatacataaaatatatggaggtgtgagattgaagaaaaaaagcaactcaaaacttaagatcattccgcttggaggccttgaaaagatcggaatgaatatcactgcctttgaatatgaagacagtattattgtagtagattgcggattgtcgttcccggaagatgatatgctcggaatcgatcttgtaatcccggatatcagttaccttaagagcaatgcggataaggtgaagggttttgtgatcacacatggacatgaggatcacattggagcgcttccttatgtgcttaaagagattaatctgccgatttatacaacaaagctgactatgggaattatcgagaaaaagctcacagagcacaatcttctccgctcaactaaaagaaaagtagtgcgccatggacagtcgatcaatcttggaaaattcagaattgaatttatcaagacgaaccacagtatccaggatgcatcggcactggcaatctattcgccggcaggtattgttgtgcataccggagactttaaggtagattatacaccggtatttggtgatgcgattgatctgcagcgttttgcagaaattggcaagaaaggggtactggcattgatgtcagacagtaccaatgcggagagacctggttttacacagtcagaaaggacagtgggagctacatttgaccggctttttgccgaacactccaatacaagaattattgtagcaaccttcgcttcgaatgtagaccgtgtacagcagatcatcaatacgtcttacaagtatggacgtaaagtagttgtagaaggccgcagtatggtaaatatcatttcggttgcatcagagcttggctatttgaatgtgccggagaatacgctgatcgagacagatcagttgaaaaactatccaagagagaagacaacgatcatcacaaccggaagccagggagaatctatggcggctctgtcacgtatggcagcagatatccataagaagatctcgatcatgccgggtgacacgatcattttaagctctaatccgatcccgggtaatgaaaaagcggtatcgaatatcatcaatgaactctctgaaaagggagcgaatgttattttccaggatacgcacgtatccggacatgcgtgccaggaagagctgaagctgatctattcactggtaaaaccaaaatatgcaattccggttcacggagaataccgtcatctgaaagcgaacgcaggtattgcaaaatctcttgggattccgaaggacaacatttttatcctcaagtcaggcgatgtactcgcactggatgatgaaagtgcagaagttttagataaggtacacacaggagaaattctggtagatggactcggtgttggtgatgtcggtaatattgtactgcgtgatcgtcagcatctggcagaagacggaatcctgattgttgttctgacactggaaaagcgtaccaaccagcttcttgccggacctgatatcgtatcccgtggatttgtttatgtacgtgaatctgaaagcctgatggaagaggcacggaaggttgttacggaagcggttgaaaaatgtctgatgagccgtcatgctgactggagcaagattaagcttgtgatccgcgacacaatgaatgattttatctggaaaagaaccaagagaaaaccaatgatccttccgatcattatggatgtataatataaagatgcctgtggcatttttatgaaaataagcagatgcgaagatatctgcataaagaagcgcagtcagagttgaaaagaaaataaactttgtctgcgcttctatgataaatgtataggataagaattcccttggaagaaaagaggaagatatgatagtagaagaacgactgacgacttacctccattctctggaaagcgcggacatccccgttctcgatgagatcgaacaggaagcccttgcggacatggttccgatcatccgcaaagagacaaaaagttttctgaaagtaatgctggagatcaaacgtccggtaaagattcttgaaattgggacagcagttggattttcggcaattctgatgggaaaatattctccggaggaatgtcgcattacaacaatcgaaaattacgaaaaaaggattccaattgccagagccaattttgccagggcaggtatggaacagaaaattatgttgcttgaaggcgatgcactggagattatgaaaggcatgccggatgatgcaggatttgattttgtgtttatggatgccgcaaagggacaatatccggcatatttagaacaggtgatgcgtttccttgtgccgggagggatcctgatcacggataatgtgttgcaggacggagatattattgagtcacggtttgcggtggaaagaagagaccgcacgatccatagccggatgagggagtatctgtatactctgaaacatcatcctgagcttgagacatctattcttccgctgggagatggagtggcactgagcgtgcgaaaataaaaacaggagataacagtaacagaaaggaaaaaaataatgtcaagacatcctgaattattgataccggcaagcagcctggaagtgttgaagactgcagtcgtatttggagcagatgcagtttatattggaggagaagcatttggacttcgtgcaaaggcaaagaacttttccaaagaagatatgatggaaggaatccggtttgcacatgagcatgatgtaaaagtatatgtaactgcaaatattctggcacataactacgatctggaaggcgtgcgggaatattttaaagagttaaaggaaataaaaccggatgcattgatcattgctgatccgggtgtatttgagatcgcaaaagaagtatgtccggaaattgaaagacatgtgagtacacaggccaataatacaaattatgcaacttatatgttctggtacagacaaggggcgagcagagttgtatctgcaagagaactttccatgcgtgagatcaaagaaatccgtgcacatatcccggatgatctggagattgagacattcgtacacggtgcaatgtgtatttcttattccggaagatgtctgctcagtaatttctttacaggcagggatgcaaaccatggcgcatgcactcatccgtgccgctggaaatattctgttgtggaagaaacccgtccgggagaatatatgccggtttatgaaaatgagagaggaacgtatattttcaattcaaaagacctctgcatgatcgaacatattccggagcttatcgatgcggggattgacagcttcaagatcgaaggaagaatgaaaacggctctgtatgtggcaactgtagcgagaacataccggaaagcaattgatgattatcagaaagatccggagctttacaggaagaatatgccgtggtatctggaccagatctcgaattgtacctatcggcagtttacaactggatttttctttggaaaaccatcggaagaggcacagatttatgacagcaacacctatatccgggagtacacatatcttggaatcacagaagagattaaagacggtatggtgaagatcgaacagagaaataaattttcggtgggcgagacgattgagatcatgaaaccgaacggagataacgtggaggttcaggtaaaacggatcgtaaatgaagaaggagaagaacaggagagtgcaccacatccgaagcaggtactgtatgtagaactgtccggtagggctgacaagtacgatattctcagaagaaaagaggaagcagatgaataaaaaaacgtggaagccatatgcggcgatcgtactgatccttctgtacggcgtggatatattctggctttccagattttgtgtctattattttggtgagtggggaattccaatgtatgagggtcttcttgcggtgctggcacttggaatagtagtgcttttcagggaagacgtaaagcgtgcatttccatttcacagaccgacgatcgcaaagactgtcggaacattgctgatgtggatcggaacccttctgatcacgatgattccgacatcgatcctgctttatgtatttccggagcagatgagtggggctacagaaagtgtgagtgaattatccggcggactgccgtttggacttgcatttcttctgatctgtgtcacgccggcgatttttgaggaaatagcattcagaggcgggcttttcagctgttttcgtggctttaggagtccatggccggcaattctgatcagtgcagcagtgttcggtgcatttcacggaagcttctggcggtttgtgccgacagcgatgcttggaatcgccatgggatatctgcttgccgagacggataacatgttttataacatgttcttccatctgatcaataatgcgttaccgacattgcttttacagcttacttccagtgtggcttcagagcagatggaaagtgcagaagctatggcatcgacaggcattttgcttgtgacggtggcggtgtattttatttatgcttcggcaggaccgtttctgatttatgcgggaaattacctgatccataaaggacagccaggatacgacaggggacttctgccaagagagaaaaagaaaactctgttggggcttgtgcttgtaagtagcgtctttctgggacttggcattctgctttttggtataggaatgtttgagtagagtgtcctgtctgccggtgtgaaagaagcatcatgaattttaaaatggacagacaggatttagaccggcaaaaattaaaaatgagaaggaagaaagcaggggcggagtttttgaatcgcccctttttcaattcgcgaaacgtaggaacgtgagatgccaagagaagctgcaacttctttctgggtatattctttttcaccataaagaccgtagcgttttttcagtaccagctgttcgcggtcggtgagaacggattccagtttttcatagagaagagaaatatcatttttcagggcaagctgcatacaggcatcttcttcatcagattcgatgacatcatacaggcggatctcattcccttcccggtctgtaccaatcgcttcgtatagggaggtttcccggttactcttccgcttggtgcgcagcatcatcagaagttcattttcgatgcagcggcaggcgtaggtggcaagccgggcttttttgtccgggttaaaggtggaaactgctttgataaggccgatggttccaatggacagaagatcttctgtatcgtcctccagatgctgatatttttttatgacatgagcgaccagacggagattgcgctcgatcagaatatgacgggcctcattgtcaccgtctgcactgcgtctcagaagctcggattcctcttttggagtaagaggcggaggaaaggatttcaatacgattacctcaaaatagagttactaacattgtatgtaaaagtgaaatgttctgtgcttttccattcgggttattttgcgcttgtggtacgtctgaaaatgcgttataatgagcgttgaatcatgtagtagcagatatagtttacaaaagaaatgagattacgagagaaaaggaaaaaattatgggaataaggacaagattagcggtacttgcctgtaagacatccaatgcagtcctgcggcggatgggacgaggcggaacgaacctgccgggcaagatcgcattaaaaattgacaaagatattttaaaggaattatcacgtggggtgaaggttacggtagtgaccggaaccaatggaaagacgaccacgtcccgtatgatcgagcaggcatttgaagaagccggatataagtacttcgcaaataaatcaggtgccaatcttctgaccgggatcattacagtgtttgcacagcactgcagtctttctggcaagtgttcctacacacacgcactgatcgagtgcgatgaggcagcgttccgtaagaccagtgagatgctgccggtagagtgtctggtagtcaacaatattttccgtgaccagttggacagatatggggagatcacccacacgttgaatgcaatccgcgaaggaattacccacgtaccggatgcaaccctgtgcctgaacgcggactgttcattgacgtcatctcttgcagatgatgtaccgaataaggttgtatggttcggggtggatgtgccgatttacaaagagacagcgtttgaattgtctgatgcagtgtactgtattcattgtaagacagaatatgaatacgattacagaacttacagccatcttggcggtttccgctgtccgaaatgtggatatcaccggcagacaccgcaggttggcgtgacgcaggtagtgcgtaccggagcagattcttcggatatcgtgttaaatgcattcgggcatagccatgatgtgcacattaatcttccgggaggttacaatatttacaatgcggcagcctgtgttgcggctgcggagattgttggaatcgatgaagacacagcagttgatgcactcagcagatttgagtgtggtttcggacgtgcggaacagtttgaacttggcaagtctaaagcacgtatgatgcttgtcaagaacccggcagggtacaatcaggtcatcaaccagatctctaatgatgaggaagagtgcaagattgcgttccttctgaacgaccgttatgcagatggaaccgatatcagctggatctgggatgtggattttgaagcacttgcccgccagagcgcacgctttacccgtattctggtatccggagtccgtgcagatgatatggcactccgcctgaaatatgcaggatttgacactggacggattgaagtgatccgcgactatgagaatcttttagaagcaatcggagcggatgagacaccgacatttattatgccgacttataccgctatgtttgatctgcgcggcgagatcagcaagcataccgatattaaggcattttacgaataaggagggaattatggaactgaatatttgtcatctctatccggacatccttaatctgtatggagaccggggcaatatcattacaatgaaacgtcgtatggaggatcggggaatcaaggtcaatgtagaaggctgctcgatcggagaaactctggatgcaaaccgctatgatatcttcttcattggcggaggtcaggattttgaacaggaagtccttctgaaagacctggggaccggaaaagcagcagagatccgcgcggctgtggaagatgaaaagaccttccttgcaatctgcggaggctatcagatgcttggccagtattataagacctgggatggtgtccagctcgattttaccggcgcgatcaacattcataccgttggatcaaaagagcgtatgatcggcaattatatgtttgagaccctcccggagagcagtggagctgtcgtagtcggctttgaaaatcattccggcaagacctacctgggtgaaggcgtatcaccactcggcaaaatgctcaaaggctacggcaacaacggagaagaccaaaccgaaggagcccgctacaaaaatgtcttcggaacctattcgcacggctcccttttaccaaagaacccggtactctgcgattttatattacaaactgccctagaacgcaaatacggtcaaatagaaccacttgcgccactggacgacaccttagaattaaacgccaacgaatacatgaaacaaagattaagtaaataatgcttatttagaaaatgccactgcacacagggttccatcccacctgtgcagtggcattttgtcccatctatgatacagcaaggcaaaactttgccagtaaagtacggcggttgtcgtgggaaaatcatctctttcgatttacttattgtgcaatggagagaagactcaaaaattgtggaagccattgctgacacaattttcgctttcagaggcttctcggaatggtttgcacaatggaatcgaaagagatgattctcccacgatgacctcacaacctactcccacaaatttcccctcccaatcatcttgacaaaattccctacccatactatcataaggatacattttctaaaagatatcggttttcttttagcaaatcactcatggcatttcgccatacattttctgaaataaaacttctgaacttttgccggggaaaggcaagggtgaatttaatatgggattttataaggtacattcggcaacgattctggggctgaaagtagaatttgtgcaggtagaggcagatgcagggaacggacttccaatgtttcatatggtgggatacctgtcttctgaggtaaaggaagccgcagaacgggtaagaactgccatgcgtaatgccggttatatcatgccggcgaaaaagattgtaatcaatctgtcgccggcatgtgtccgcaagaagggatcggtatttgatcttccaattgcagttgcagtacttggggcaatggggattttcccggaaaaagcagtggaggatattttacttgcaggagagctcggactggatggaaagctgcagccggtagagggaatccttccgattgttctggaagcaaagaaggctggttttaggtgttgtgtgattccgaagtcaaatgaggatgagggaaggctggcgcagggaatacagatttttggggcagagactctggaggaggtatgcagatggctgaagggtgagtatatgcctcagatggagaaaactgaccaggaagaggctcatggaacggaagaatgggacatagattatagtgatattcagggacaggaagcagtaaaaagagcgacgatggtggcggtggcaggaggacataacctgctttatgtcggtccgcctggttccggaaagacgatgcttgccaaacggatcccgacgatcctaccaccgcttgatcgggaagaaagtctggagatcacggggatttacagtacggctggactgcttaaaagaaagaatccgctgatctggcagagaccgttccgggaggtccatcatactgtgacgcgggcagcgctcatcggaggcggacgaatcccatcgccaggagaagcaacacttgcgcatggaggtgtcctttttctggatgagctggcggagtttccgagaggtgttctggaagtgctcaggcagccgctggaagaaaaatgcattcatctggcaaggcagcagggagcttatatttttccggcagactttatgttggttgctgcaacgaatccatgtccctgcggaatggctcctggtccccaatgtacctgtacgcccgggcagatccggaattatcagggaaagttgagccagccgtttctggatcggattgatatctgcatggaggcacccaaggtcgaatatgaagaactgaccggaaagggaacagggatggattccagaaccatgcgaggaaaagtgatgcttgcaagaatgcgtcagatggatcgttttcgagaagaaaagctgacaaaaaatgcacagatggggcaaaatgaaattgaaaaatactgccgtcttgggaaagaggaagaacggatgatgcgccaggcttatgaagtgatgaagctgacggtgagaagctatcataaagtgttgaaggtggcacggacgatcgcagatatggaggaaaaagaggagatcgatcttgtgacactccgagaggcactgggttatcgggttatggataaagaatattggggataagagaaatgagtgaaatgtggtatacatactggctggcgtgtgtggaaggaatcacgggtgacagaaagtgtgaattatgcagaaagaacggatctgcggaagcagtatattatatagaagaaaaagggatcagagaacagataattacagaaaaagagtgggggatcctgaaagaaagtaagaaaaaaaggaattggagggaagcgtatcaaaaagtggtggatcggggaattcagatggcagtccggggacagaacaattatccgaaacggtttgaagaacttgcgggaatgccgtatgcactcttttttatcggggagatgccacgggagggaatgccgtcggtggcagtggtgggtgccagaagatgtagcagctatggtgaaaaaatgacgcttcgctttgttgaaagacttgcggagagcggaatccagatcatcagtggaatggcactgggaattgacggaatggcacaccgggctgcattaaatgtcggagggaaaacatttgcggttctgggaggcggagcagatgtatgttatcctgcggcacataaaggactctataaagatttaataaagcggggaggcatactgtctgaacagccaccgggaactccaccggttgcctggcattttccggcaagaaaccgtctgatcagcggacttgccgatgtggtacttgttatggaggcaaaagaaaagagcggatccctgattacagcagacatggctcttgaacagggaagagacatttatgctctcccggggatggtgacagagccgctgagctgtggttgtaaccgcctgattcggcagggagcagggattcttctgaatgaagaagatttgctggaagaactggttataaaagggctgctaaagaagaaaatcgcaattatatcagacacgaaaaataaaataaagcttgaaacgaaagaaaatttggtgtatagtaagctcggtttgtatccgcgggggctggatgatttacagagagaaaccggacttactccacaggaggtgatgggaatctgtgtatctcttcagttgaaaggatgcattcaggaaagatcaaaaaattattatgtcagagctaaatgatctgacactattaatatggaggaatataatatatggcacgttatcttgtgattgtagagtcaccgacaaaagtgaagaccataaagaaatttctcggcagcaattacgtggtaatggcatcaaacggacatgtaagagatttgccgaaaagtcagatgggagtagacctggagcatgactttgagccgaaatacattacaatcagaggaaaaggtgagatccttgcaggacttagaaaagaagtaaaaaaagcagataagatttatcttgcaactgacccggaccgcgaaggagaagcaatttcctggcacttgatgaaagcacttaagctggaaggaaagaaagtataccggatcagctttaacgagatcactaaaagtgcggtaaaggcatccctgaaaaatgcacgtgatatcgacatggatctggtagatgcgcagcaggcgcgtcgtgtgctggatcgtatcgtgggatataagatcagtccggttctgtgggcaaaagtaaaaagaggacttagtgccggtcgtgtgcagtctgtggcacttcgcatcattgcagaccgagaagatgagatcgcagcgtttattccggaagaatactggtcactggacgccaatttcaaggtaaagggagaaaagaagcctcttacagcaaaattctatggaaccaaggatgagaagatcaccatccataacgaagaagaactgcataagattcttgcagatctggaagaggcagaatatgaagtggtcgatgtaaaacgcggagagagaagtaaaaaagcaccgcttccgtttacgaccagtacccttcagcaggaggcatccaaagcactgaattttgcaacttcaaagacgatgcgtatcgcacagcagctttatgaaggtgtggatattaaaggaagtggaacggttggtctgatcacttacctgcgtacggattcgacccgtatttctgaggaggcggatgcaaatgcaagagcctatgttggaaaagcctacggagaagagtatgtggcagagactgcatcggaacagaagcagaaaaatgacgggaaaaatattcaggatgcacacgaagccatccgcccgtcagatgttacccgtgttccggcagaaatcaaagaatctcttacaagagaccagttccgtctgtatcagctgatctggaagcgttttgtggcgagcagaatgcagccggcaaaatatgagacaacttctgttaaaattggagcagatgattaccgttttacggtatcggcatctaagattatatttgaaggtttccgtctggcatatgtggaaagcgatgaggaaaaacagagtggaaatgtaatggtcaatagtattgataaagattcagaactgacgaaagaatcctttgactataagcagcatttcacacagccacctgcacattacaccgaggcatctcttgtaaagacactggaagaacttggaatcggacgtccgagtacctatgcaccaacaatctctacgatcattacaagaagatacgttgcaaaagagaacaagaatctttatatgacagagcttggtgaagtggtcaataatattatgaagcagtctttcgcaagcattgttgatgtcaactttaccgcttatatggaaggacttctggatatgatcgcagaaggaaaggtagagtggaaatcggttatcagcaatttctatccggatctgaaagaagcggttgaaaaagcagaaaaagagctggaaacagttaaaatcgaggatgaggtaaccgatgtagtctgcgaagaatgtggaagaaatatggttatcaaatacggtccccatggaaagttccttgcatgtccaggattcccggaatgccgcaacaccaaaccgtatctggagaaaatcggagttgcctgcccgaaatgtggaaaagacattgtattgcgcaagacaaagaaaggcagacgttattatggatgtgaggataatccggaatgtgattttatgtcatggcagaagccgtcagaagaaaaatgtccgaaatgcggaagttatatggtagaaaagggaaataaacttgtctgcggtaatgaacagtgtgggtttgttaaaaataaagagaaagatgaaaaataaatcaaatttcattgaactattcagaattgtatgataatatatttgtgtgcacatttttttgactaatttgtgtgcataatttcaacaatatttcatattcgtgaaaaatgcgaccggaaacgcacatttttaataaaaatatatggaggcagatatgagcgtacaactattggataaaacaagaaaaattaacaaactgttgcacaataataattcaagcaaagttgtgtttacagatatctgtgaagttctgacagagattctggcatcgaatgtactggtagtcagtaagaaaggaaaggtacttggtgtcagcacatgcgaaggagtcccggagatccatgagcttttgcaggacgaagtgggagaacatattgatccgatgttaaatgaacgtcttctaagtattctttccacaaaagagaatgttaatctgcagacacttggatttacagctgatgtatcccagggatatcaggcgatcattactccgatcaacattgcaggagagagacttggaactttgtttttatacagaaaagagtccatgtacgaaattgatgacatcattttgagtgagtacggaaccactgtcgtgggacttgagatgctccgctctgttaatgaagagagtgcagaagagaccagaaaagaacagatcgtacaatctgcgatcagcaccctttctttctctgagctggaagcaatcatccatatttttgatgaacttaacggaatggaagggattctggtggcaagcaagattgcagaccgtgtgggaatcacccgttctgtaattgtcaatgcactccgcaaatttgagagtgcgggtgtgatcgaatcccgttcatccggtatgaaaggaacttacatcaaggttgtgaatgattacgtgttcaaagaactggataagatcaaaaaagaaaaaatgaattaaggataaaagtaaaagaggggtatcagacaaatctgatgcccttttctttaacggggaattatatttgtaagaaggagagaagagagcatgtatgatggagataaagctgtacttacgatggtacagtatctgaaagaagataaggaaaaagatgagaatatttatgaggcaacagtcatagaatatcagaaggagatggagcaggtacatctgatcctgcgctcaggcagtctttctgatatttcactggatgcagtatatgaatgccggatccggacgatcacttgtgagactgtgtgtacagggatgataaaggagcgttatgagaaccgtgcaggtatgattctggtcctgcaggtgacgaatggattttatgaaataaatctaaagtaattataaaattcaaaatcgaatgttgacaaaaaagaaagagagtgctatcttatacctagaaagtttttagcactcgattttgttgagtgctaacaagatagagttaggaggaattataatgaaattagaaccattagctgacagagttgtattaaaacagttagttgcagaggagactaccaaatcaggaatcgtacttcctggacagtcaaaggaaaaaccacagcaggcagaagttgttgctgtaggacctggcggagttgttgatggaaaagaagttacgatgaatgtttcagtaggtgataaagttatctattccaaatatgcaggtacagaagtagaactcgatgatgaagaatacatcattgtaaaacagaatgatattcttgcagtgatcagataatccggcaggatatcatatacagataaaaatcagattttcagattagaacagaattttatttttaagaatcaggagtgatagaaatggcaaaggaaattaaatacggagcagacgcaagaaaggcactggaagcaggtgtcaacaaacttgctgatacagtaagagtaacaatcggaccaaaaggaagaaacgtagttctggataaatcattcggagcaccgcttatcacaaatgacggtgtaacaatcgcaaaagaaatcgaactggaagatgcatttgaaaatatgggagcacagctgatccgtgaagttgcatctaagaccaacgatgttgcaggtgatggtacaacaacagcaactgttcttgcacaggctatggtacacgaaggaatgaagaacctggaagcaggtgcaaacccgatcgtattaagaaaaggtatgaagaaagcaacagactgtgctgtagaagctatcaagaagatgagcagcaaagttacaggaagagagcagatcgcaagagtagcagctatctcagcaagtgatgacagtgttggtgagatggtagcagaagctatggacaaagtttccaacgatggcgttatcacaattgaagagtcaaagacaatgaagacagagcttgaccttgtagaaggtatgcaattcgaccgtggatatatttcagcatatatgtgcactgatatggaaaagatggaagcaaatcttgacgatccatatatcctgatcacagacaagaagatttctaatattcaggaaatccttccactgctggaacagatcgtacagtcaggagcaaaacttcttatcgtagcagaagatatcgaaggagaagctcttacaactctgatcgtcaacaaattgcgtggaacattcaatgtagttgcagtaaaagcacctggatatggtgacagaagaaaagctatgctggaagatattgcaaccttaacaggcggacaggtaatctcagaagaacttggtctggaactgaaagatacaacaatggcacagcttggacgtgcaaaatctgtaaaagttcagaaagagaatacagtcatcgttgatggtatgggcgataaggctgctctggaagccagaatcggacagattaaagctcagatcgaagagacaacatctgattttgataaagaaaaacttcaggaaagacttgcaaaactcgccggcggagttgcagttatccgtgtaggtgctgctactgagacagagatgaaagaagcaaaactccgtatggaagatgctcttaatgcaacaagagcagcagtagaagaaggaatcattgcaggtggtggatcagcatacattcatgcatcaaaagaagttgccaaacttgcagaaactctggaaggtgatgaaaagacaggggcaaaagtagtcctcaaagctctggaagcaccattattccacatttcagctaacgcaggtcttgaaggtgcagttatcatcaacaaggtaagagaagctgaaccgggaaatggctttgatgcttacaatgaagaatatgtagatatggtgaaagcaggtatccttgatcctgcaaaagtaacaagaagcgcactgcagaacgctacaagtgttgcatctacactccttacaacagaatccgttgttgctaacatcaaagaagatgcaccggctatgccggcaggcggagctccgggaatgggcatgatgtaagctaaaaatatgatttttagaaaactcctcagaagaggagttttctttttattataaaagtgttacaatagttctaatatataaatttggaggttaggatatgggtgatttttacacagaacagctggtgaagaggcagaaagcatcttcgacgacgctgatcaaagcaatacttatcatacttactgttctgtcggtcgtacttatatttatgatcccattcggaataattggtccggtgatcatgatcgcactggatgtttttttgttccggagtatggatgttgaatatgagtatttatttgtgaatgggagtcttgatattgataagattatggcaaaatcccgtcggaaaaatatgttttccatggagatgacggatcttgagatgatggcaccttccggttcgccggaactcagaccttatcaaggactgaaaggaaccgattacagttcaggtatgccgggggcagatacatatgagctgatcgttgtaaataacggggaaaagaaaaaaattatttttgagccaaataaggcagtttgtgaaggactgaagatgctggcaccaagaaaagtattttgtaaataattcccgaaagacgtgcagaaaagcttgcaggttccggggtacaattgcatccagaaagacggttacgtaaaattatcagtgatctgtagaaatgtgattgtcacggacggacgaatgtactcgataaaggacttgacatagcatagatttatgcgttatcatagcagataatcaaaattacagacgagagagaaaggaagaaaaatcatgggaaagattattggagaaggaatcaccttcgatgatgtacttctggtaccttcttattcagaagtaattccaaatcaggttgatttatcaacttatcttacaaagggcattaagcttaacataccgatgatgagtgcgggaatggacactgttaccgaacatcgtatggcgatcgctatggcacgccagggaggtatcggtattattcacaagaatatgtcgattgaacagcaggcagaagaagtagacaaggttaagcgttctgagaatggtgtcattacagatccattctatctgtcgccggagcatacactggcagatgctaatgaactgatggcgaagttccgtatttccggagttccgatcacagagggaagaaagctggtaggtatcattacgaaccgtgacctcaagtttgaagaagatttctccaagaagatcaaagaatccatgacaagcgaaggtcttgtaacagcacaggaaggtatcaccctggaagaagcaaagaagatcctcgcaaaagcaagaaaagaaaaacttccaatcgtagacaaagattttaacttaaaaggtctgatcacaattaaagatattgagaaacagatcaaatacccactgtcagcaaaagacgcgcagggaagacttctgtgtggtgcagcgatcggtattacagcgaactgtcttgaaagagcagaagctcttgtaaaagcaaaagttgatgtagtagtacttgattcggcacacggacattcagcaaatgtacttcgtaccgtaagaatgatcaaggatgcattcccggatcttcaggtgatcgcaggtaacgttgcaacaggagaagcaacaaaagcgctgatcgatgcaggtgttgatgcagtaaaggttggtatcggacctggatccatctgtacaacccgtatcgtagccggtatcggtgtaccacagatcacagctgttatggactgctacgaagcagcaaaagagtcgggaattccgattattgcagatggtggtattaagtactcaggtgatatgacaaaggcgatcgcagccggagccaacgtatgtatgatgggaagtatcttcgcaggatgcgatgagagcccgggaacattcgaactctatcagggaagaaaatacaaagtatatcgtggaatgggatctatcgcagcaatggagaacggaagcaaagacagatacttccagacagatgcgaagaagcttgtaccggaaggcgtagaaggacgagttgcctataaaggatctgtagaagatactgtattccagttaatgggcggtcttcgttccggaatgggttattgtggagcaccagacatcgaaactctcaagacaacaggacgtttcgtaaaaatttcttccgcatccctcaaagaaagccatccacacgacatccacatcacaaaagaagcaccaaactacagcgtagatgaataagatgcaaaattaatcaagagagaagaatcatttccgtaagagagacgattcttctctcttacattatccaactattttcaaacttcacccaaaccttcaacagtcaactgaatcaccggagaaagggagaatcagtgtgcgccggagaaaaaacaattgccgttggattcgattgttgtgcaatggagatgaaacacaaaaatcgtggaagcctctgctgaacacgattttcgccctaagtggttcatcggaatggtttgcacaacggaatccagcggcaattgttttttcggaggggtacacgtccccttccgactaccttaataaaaaaataataattttttcaacaatttctcatcattttatgatagtctggatatagttgggattccaacagaaaatttgcaaaaaacacaaaagattgagatgacgaaatgaaccgaagaaagaagaaaaacaccagagccaacctgtacaggggtggcgatggaaaaagctattatgaggcgaataagaggcgcagaatgagccgttatataaaggtgggaagtacgatcctgatcacactgcttcttgcactttctattatgaagatcagtggaagaggaatctttgcacagagagcatacagtgagctttctgatgaagtgatcagtgcccaaaagccggatattgatgtagaactgttaactgtgaatgaatattcaagaccgggactttcaaccaatgagattaccggaatagtcattcattacactgccaatcctggttcgacagcgatggagaacagagactattttgagggactgaaggacagtcacattacgcaggcaagcagtaattttgtagtaggactggacggggaaatcgtacagtgcgtaccaacctgggaggttgcttatgcgtccaatacacggaattttgatacggtgtccattgagtgctgtcatccggatgagaccggaaagttcaacgaggcaacttataagagcatggtacaacttacagcatggctgtgtgaaaagttttcgctgacagaagaagatgtgatccgacattatgatattacagggaaaatctgtccgaaatactttgtcgaaaatgaagatgcctggaagcagtttaaaagtgatgtaaaagcggtcctggataacgcaaaataaaaaatatctattgattcacttccaaagtgtctgctataatgttttaatacaacgggcaattgaaggcacccggaaagcagtagagtgagaaacgaggaattgatagatgaacgatttggaattataccgtgaagagcttgcaaactgtgatgcgaagatcacagaggcattaaaagaaagatatgcgatcattgaaaagatcatggcatacaaagaagagtatggtatgccgatcctgcagccggaacaggaagaaaagcagaagaagagactgatgttcagccttcacaatgataagcacagagacgagatttatgatgtatttgagcgtatccagcgcaacagtaagaagatccaggctagaaagctttttgattacaacattgtcctgatcgggtttatgggagctggaaaaagtacgatctctgattatcttagcaccatgtttgccatggaagtggttgagatggaccagctgattgcagaacgcgaaggcatgagtatttccgatatttttgaaacctatggggaggaatacttccgtaatatggaaaccaatcttctgatcgagatgcaggagaagaagaatgtgatcatttcctgtggtggtggtgtggcaatgcgtgaacgcaatgtcgcagagatgaagaaaaatggtcgtgtagtactccttactgcacatccacagaccattcttgaccgtgtaaaagacagtgacgacagaccgctgctcaatggacacaagaatgtagaatatatcgagcagctgatggaagcaagaagagaaaaatacgaggcggctgcagatatcgttgtagatacagataacaagacggttctgcagatctgtgaagatctgattcagaagcttctggaaatggatgagaatcatgtttaagaccttttatccggacgaatatgtagcgtccacttatgtactggattttgaaaaaatgtatcgggaaggctgtcgtggactggtatttgacattgacaatacgctggttccgcatggagcaccggcagatgagagagcaatctgtctttttgacaggctgcgcagcatcgggtttgatacatgcctgatttccaataaccaggaaccacgtgtaaagccttttgccgaaaaggtgcagagcaagtatgtgtttaacgcgcataagccttccacgaagaattatataaaagccatggagctgatgcaaacggacagaggaaacactgtatttatcggagatcagctttttacggatgtgtggggagcgaagcgtaccgggatgaagagtattctggtgaagccgatcaatccaaaagaagagatccagattgtgctgaaaagatatctggagaagattgtattacatttctataaaaaagagaacgaaaagagaatgtcctgcaagtaggcagggcattttttgataggaaattccgaaggaacttcctatcaaataaaaggcactgcgtgccaaagatgtgcactcgcacgaagatgaagaatgtcgcaagcgactgcgctcggcgcgaaaatgtgccttggcacattctttttagtaaagtaaatagaaatccccccggttctcataacgagaaccgggggacatcaggggggatattatatttacaaaatcttataagtagtcatgtttggcaagaacattcaggatattacgtccttcttctgtaccttcgatgatacggcgggcacgtacactgtcaccgatgttcatgatttcaacatcttcatcttcgaattctttacggactgcatcgaggatcggagcgtttgctctcataccaagacatacaaatccataatcaaatagcatttcttcttcatttccttctggcgttttaacaaggaaggaatctgctttaacttcaagaagagcagtattcggacactgttttacaccatatttatccatcagtgcaaaggttccgactttggataccggatcaattccgttaccgattaccggcatcatttccacaatgcttacatcagcgccacgtggagcaaagaattctactacgtcaagacctacggcaccgccaccgataacaacgacttttttacctttcagatcttctggatattccataacatggttgatcatatttgtaatagaagaaacttttccgccctctttgtcaatattctcatgaagacccttgatcggtggaaggagcggattagaaccggtagcatttacaataatgttcgggttcatgcttctgatcatttcaatcgtagcttccgtgttcttgaagatgaacaggtttttcagcttgcttgcgcgatggatcagatagttcgggaagtcagcaagtctcttcttatccgggatcttggagatcagggcggcaagtccgccgagttccggtttcttctcgatcaggaaagtagtgcatccaacctcggcagctgtacatgcagcttccagtccggcagtaccaccaccgatcacaacaacgttgcaaggcttgttgattttctgctttttgtaatcttcgccgccatttacagacgggttaacagtacaacggatcggacggttgattccgatacggtgtcctgcacatccgatgttacaagaaatacatttacggatatcacattcatcaccgaattctactttatttacccattctggatcagcgatcagtccacgtcccataccgatcaggtcagcatcgcctcttgcaagaatatcttcggcaacctgtgggttacggatgttacccattgtcatacatggtttgccgtaacgttcttttacagcttttgccatataagaacgccatccatccggaaggtaattggcatcaatctggtactgaatggatccgttcagaccggcagatacgtcgaatacgtcaacctcttcctggaagtactgcaggtaatcaagacagtcatccaaagtatttccgccttccataaattcatccgcactgatacgaacaaagatagggaagaatggtccaacctgtcttctaacttcttcaataacaagttttgcaagtcttgcacggttttccaaagatccgccgaattcgtctgttctcttatttgtaagaggtgaaaggaactggcttataaggtaagaatgtcctgcgtggatttctacagcgtcaaaccctgcgatctgagcacgttttgcggcttcaccgtatttttttacaatatgcatgatttcatctttttccagtggacgcgggatttcaccgcctgcttttgaaggaacatcagaagcagaaaccggctgcatattgatacgtgctgactgtgcagaagcaccggcatgattgatctggattgcaatgcaggatccatgtttgtgtactgtttcgcaaagtttgaaaagtcttggaatgtagttatcctgatcgatacgaagctgtgtggttccgttagatccctgtggagaatcaacgctggcgttctctacgatgagaagtcctgtaccgccttttgcacgttgctcgtaataattgatatgaagaaaactcatttcaccattctgttcaccgtagttggttcccattggagtcatgacgatacggttcttgaccgtcatatgtttgatggtaaatggctcgaaaatgtgtttgtatttgcttttcattagaaattcctccgtaaaaatgacttaataatcaaaataaaatgatgtgagtgtcaaaagtgaattttgccactcactgatgtaatcggattgcttcattgctatgcaattcctgcaatcctcaaaaaatcttagtcacgcgaggttgtcttataccggcttgggcgtaccggtttttgttaaatccattataatcacaaaaaactgaaaaatacaaattgaaaatacatagaaaaataatagaatataactatagaaacggtgaaaaagataaaaataaaattatattagggagacgggaaatggaaaaagatagacaatttaaacaaaactatagaataattaaataatttatgctatgtttaatataagaacaggaaagagggtgatggttttatgaatctgaatcagttgcattactttgtgacactggcacatatagaacactataccagagcggcggaaatgctgtccattacgcagccaagtctcagccatgccatcagtatgctggagcaggagcttgagacaaacctgtttgaaaaaagagggcgtaacgttgtactgacaaagtacggaaaagtatttctggaatatgtagaagaagctttaaagattctggacagtggtgtaaaaaagacaagggcgttgacaagtgacaccggcggggtgatcgatctcgcatatatttttacgcttggaagtgtatttgttccacagcttgtaggcggttttttgaaggaacacgaagactgggatgtgaatttccgtttttctgtcggaaatacgacagagattatacaggggttgaaagaggagaagtatgacatcgctctctgctcgcgaaaagaaaaagaatccgggattgattttgtaccgatcgctaaggaaaaattggttgttgttgttccaagagaccatgagcttgccggaagaggatcggttgatctgaaggaaacacttccttatccccaggtatatttcaccaagaacagcgggctcagaccggtgatcgaccagttgtttgaacagaccggagggacaccgaagatagcatatgagattctggaagatgcatcgatggcaggtcttgtggcagaaaattttggaattgcggtaatgccggagattcctatacttaaaaatctgaatgtagatgtactggatattgagaatccaccatacgaacgttatatatatctggcgaagctgaaggaaaaatatctggcgccggttgtaaaagaatttattgaatatgtaaaagaaagcaatgggaaggcactttaataggccttcccatctcttttgacaaactggatgaaacgtttgacagcgggaatctggtatttgtcgcggatgtatcccatataaacggtgtgggtaaggtctgcatcggcaagcgggagtacggttacatttgcctgatcaaccgcatcgaccctggcaacaagggcgattccgaaatcttcggcaaccagggcagcaattgcgttttcatccggacactcacagacgatgtttaccttcagcttcttttctttatagaagttacgggtgaagccaccgagtccggaatagcggtcatacccgatcagaggatagtcagtaaggtcactgcaacagacggattctttctggacaagaggatgttcttttggagtaattacaaccatattctggttcagaatgggtacaaaggaaatatccggttcatccgcaacgaaagaaccaaagatcacatcgtggcggtcggatttgagcccctggatcatatctgcagtgtgcgtttggttaaaattgaaggttacatgcttgttgcggtctatatccaggaaggatcgcactgtatgcggaatatagtagtttgccagcggaaatacataggcgatatcaatatgtccaccgcttccggcaagctgcttcatcttatgctcggcaatatgtacctcctcgaggatccggttgacatgttccaggaagacgcggccggatttggtgaggacaacattgcgtccctgatgttcaaaaagcatcagtccaagttcttcttccagaagcgacatggaccggctgaggcttggctgggagatcttaagtacttctgcagcctgtcggaaatgctgcagggttgctactttttggaaatattcaagctgatttagcgtcatggtaaaaaatcctttctatattatataaaataatcataccataactgatgctaaaaagctatcaaaaacacacataagatatatttgaactatcaaatgatatcgtctataatttaactatcaagaggttgtttaaaaattaacaaaaattgggcaaacgttaaaaacattctcaaagaacaaagaaataaatttcgatggaagaagaaaaggagaacaaatcatggcagagagaattacaggacacacagaacttatcggacttatggcttatccaatcagacattcaagctcaccggcaatgcataatgaagcatttgcttaccttggactggattatgcttaccttgcatttgaagttgacaacagcacactggaagatgcagtaaaaggacttcgtgctctgaaaatggtaggatctaacgtgtctatgccaaataaaacagttgttggacagtatctggacaaattatctccggcagcagagctttgtggagcagttaacacaatcgtaaatgaagatggtgttttaacaggacacatcacagacggcatcggattcatgcaggcattaaaagataacgatatcgatgtgatcggaaagaagatgacaatcgcaggcgcaggcggagctgctacagcaattgaaatccaggctgcacttgacggcgtaaaagaaatctctattttcaatattcatgataaattctgggcaaatgctgaagaaacagtaagaaagatcaatgaaaagacaaattgcaaagctactctttacgatctggatgacaaagaaaaattaagagaagaaatgaacgattcatacatcttcgtaaacggaacaggtgttggtatgaaaccactggaaggaatgtcagttgtaccggataaatcattcttccgtccggaacttattgttattgatgttccttactcaccactggaaacaaagatgcgttctatggcaaaagaagttggatgtaagacaatgaacggtcttggaatgatgttattccagggagcagcagcattcaaactctggacaggaaaagaaatgccgatcgaacacatgaaagaagtattaaacatcagatacgatgattaatacctggcaggcttgtattgaatttaagaagaaatcgaaaaaatttgaaaaacaggaatgtgaggaaaagagatgaataagaaatacatacccagcgccctgatcctttatttaaactactttatccacggtgtcggatgttccatccttggacaggcagtcatcaaggaagcacttgccgcttcctggggcgtagaagttatggcaatcactgcaatttcagcagcactcggacttggacgtctgatcgcgcttccgttcgccggaccgctttctgacaaactcggacgtcgtatttcaacagcgatcggtagtggatcctatgcaatctacctgatcggacttgcacttgcatttaatgcaggaacaaatggcggataccagatcgcatatatctgtgcaatcgttggtggtatcgcaaactctttcctggatacaggaatttacccggctgtttcagaaatcatttacaaagcaccgggcgttgcaactatgggaatcaaattctttatttctgtatcgcagatgctcttaccgttcgtacttggtgtaactgtcactacaacagcaacaggagcaacctcttacaacacactgttctatgcatgtggaatcgcttatcttgtacttctggtactggttatgatattcccactcccggatacagatcagaaagcagcgggaaagaaagaaggcctgatcgacagcttaaagcatacccatttctctgtagaatccatcgcaatgatcctgatcggattcacatgtacaggtaccttccagttatggctgaactgtgcacagaactttgcaaaagagaatgttggctgggctgatccgtccatcatgcagacatactattcagcaggaacaatgcttgcactcgttgtaactgcacttttaacaagaaagatcaaagacgtaagatttatcctgggatacccggtaatctgtcttgtaacaatgatcgctgttctggttgggaagagccagacacttatgattgcaggtgcattcctgatcggatgggcaggagcaggcggacttcttcagatcgcaacttctgtatgtaacatgcttttcccgaagatcaaaggaactgtaacagcacttgttatgatcgcatcttccctgtgtaactacaccatccttacagcagcatccaaaatgcagccgtcacaggttatggttatgaatatcgttcttacagcagttggagtccttcttggattatttgtaaacttacgttatactaagatggtagaacaggctcaggctgacaactagaaaaaggagaaaacagacatgagtaaatatgtagaagttcgtggtgttaagatcggtgaaggagtaccgaaaatctgtgtaccgatcgtcggaaagacaaaagaagaaattcttgcagcagcaagatcttttgaggatgttgcgcttgatgttgtagaatggcgtgtagactggttcgaaggtgtatttgacttcgcacaggttgaagatgtattaaaagaccttcgtccggcacttggcgaaactccgattcttttcacattccgtacttccaaagaaggcggcgaaaaagcaatcgaagctgacgcatatgcagagctgaacaagaaagcagcagcaacaggactggttgaccttgtggatgtagaagcatttacaggggacgaagttgtaaaagatatcatcgaaggtgcgcatgcacacggcgtaaaagtcgttgcatccaaccatgacttcgataagacaccggacaaagacgatatcgtaggacgccttgtgaaaatgcaggaacttggcgcagatatcccgaaaattgcagtaatgccacagtgcaaaaaggatgtacttacacttcttgaagcaacacgtgaaatggcagaagaacatgcagaccgtccgatcattacaatgtctatggcaggtaccggactgatcagtcgcctgtgcggtgaagtattcggttcagcacttactttcggggcagtaggaaaagcttctgcacctggacagatgaatgcatcagatttaagagaaatcctgactctgattgataagagcatctagtgaagaaacatccggagaagtcctgtggcggatccgttatgtttaacctgaatgaagagtgaaaaaggcaggataaagacccgcagtcataccggggattccggtggattgagggcctttatcatattctggttttgttaaaaaactaaccgatttctgaaagtgaaaaaattatagaaaattttgctatttaaagagataaaagcaaatagaaaaaatagacaaattcttcggtaattgatatcatttttgtatgattacatgaatggagggcaaatgcgaatgaagaaaacagtaatctggctggataactatctggaagaattttttatggtaataagcctgatcctgatgacagtgatcatggggatccaggtgttttccagatatgtactcggctcagcgccgtcctggtcggaggagattacccgttacctgtttgtatggtcgggatttttgagcgtcagctattgcacaaaaaaatgtatttccattaagatcgaacagtttgtgtcaattttcccacgaagagggaaggcactttttaaactggttaaccatacctttgaactgatggtatttctttacctgataccgtttgcgcttaagtatatgatgtcagcagtagagagcggacaggtaagtccggcgtgccacatcccgatgtattatgtgcaggcagcaccgcttgcaagttttatcctggtagcgatccgtattatccagcgatggtttgcagaattaaaagtagtaagggaaaaagatgagaaaggagaaaaagcatgccggcagcagtagtatttatcttatttgtaatctgtctgatcattgccattccggtatcgatcgcgcttacgatcgcatcggtccttccgggtgcttttgatccatccttcacagccagcggacagtttgtgatccgttctatgctgggaggaattgacagctttccgctccttgcggttccgatgttcgtactttccggaatcatcatggcaagaggcggcatttccaaaaaattatttgatgtattttcctatttccttggaaagctgacagcgggtctgccgtgcgcggtcattgtaacctgtctgttttatggtgcaatctcaggctccggaccggcgacggttgcagcagtcggaagtatgacaatcccgattctgatcgagcttggatacgataaggatttttccgcggcaatcgtagccgtggcaggtggtcttggagttattattccaccaagtattccgtttatcatgttcggaagtgcttccggtgaatcagtaagtgacctgtttatcgcagggatcattccgggacttctgatcggcggacttctgatggtctatgcagtttattactgtaaaaagaatggagaggacaaagaaaagattcagaaagtagtcggggaacttcatgagaaaggacttctgaaggttttaaaagaaagcttctgggcacttttgagtccggttatcattctgggatgcatctattccggaattgcatcgccgacagaagcggcagtcatttcagtgttttacgcactgatcgtcagcctgtttatttataagacgatgacgtttaaagatatctggccggcactggtggaaggcgtgcgcacctatgcaccgatcatgtttatccttgcagcatcgattgcattttcaagagttctgactctgatgcagatcccacagatggtaagcacctggatcctgacgcactttaccaataagatcgtcctgcttctggtgattaatgtattccttctgatcgtgggaatggtcatggataccacaccggcaatcctgatcctgacaccgatccttctgccaatcgtaacagcagtcggcatgaatccgatccactttggaatcatgatggttgtcaaccttgcaatcggatttgtaacaccgccgatcggagtcaatctgtttgtggcaagctcgcttacagatatcccgatcatgcggatttccaaacatgcgatgccaatgatcggctacttccttgttgcgcttttgttaattacatttatcccggcgatcagcctggcactgatataggaggtagcagcatgaagaaagcagtaagaatggcggtagcggcaggaatgtgtgcggcacttgcactcagtgcggggtgtcagaaaaagacggttgcggatgatgaggtacagcgatatgcatggccgcttgcaacggcgagtccggaggataccgtaacacagatctatgcagaaaaatttgcggaagaagtagaagaattaagtgatggcaagatgaagatccaggtctatccgaacggtacgatcggaggggacagagagcttctggagagctgtaaggatgggggtattccgtttgtgatccagaataccgcaccgcaggtaactttcatgccggaccttgcggtgtttgatattccgtgccgattcagtacaattgatgaagtacgtgaaaaggtagatgatccggagttctatggacttctggaggatgtctatgagaatggcggatataatctccttggctatgcagaccagggattccgtgttatgtcaacgaataaaatggtcgaatcattggctgattttaaaggacagaagatccgtaccatggagaattcctaccatatggatttctggaaaaaactgaaagcatctccgacaccgatgagtttcagtgaggtgtatatcgggctgcagcagggaaccattgatgcccaggagaatccatacgaggttatcgtatccaacaagctttatgaacagcaggattatgttgtggaaaccaatcacctgccgcatctgatctctctgatcgtcagtgatgaattttttcaggatctgccggaagataagcaggcaatccttgtagaagctgctgagatcgccaaagaagaggctcgccaggcatcggatgaccggattgcagacaagatcaaagtaattgaggacagtggaacacagattgttacacttagtgatgaactgagagcggaaatccgtgaggcagtgcagccggtttacgatgaaatcgagaaaaatgtggataaaaaactctataatgcctatatgaaatagcaaaaaaatacggaaaatcagggaaatctgtaattgattgaaattttttgttgaaaaatagagttttttattatagaattataagtaatgtatataaaaagtaaaaggaatgccccagggcatatataaggaggatattacaatgatttcagcaggcgattttagaaatggtcttacagtactgatcgaaggtaacatttatcagattctggaattccagcatgtaaaaccgggaaagggagcagctttcgttagaacaaaacttaaaaacatcatcagtggtggtgtagtagaaaagactttccgtccgacagagaaattcgataccgctcatatcgacagaaaagatatgcagtatctgtattctgatggtgaactctatcacttcatggatgttgagacattcgaccagatcgcagttgatggagatactgtaggagattccctcaagtttgtaaaagagaacgagatggttaaagtatgttcacatgaaggtaacgtattctcagtagagccgccgatcagtgtggaacttgaagttacagagacagagccgggagtaaaaggtgatacagctacaggtgctactaaaccggctatcgttgagacaggagcaagtgttcttgtaccgcttttcgttaaccagggtgacaagatcaaaattgatacccgtacaggagagtacagctcaagagcataatcctttcgtcataattcacaaaattaagacagagataaaagccgaaagcagaggcaggtcctcatgctttcggcttttttgcatgtcaatgccattttggagggaaaaagaatgttcttgtaatctgaaaaaagggcagatataattggcagtacacacctgcttgaatgcaggtgatattcaaatcataagctgccttaagatggcagaaaaggttttttgcggcgcatggctttcgggaaggagaacggatgaattatacagaatttatgaatgctatgttatgcgagatcagaggacaggtagatgcgcaggtgaggacggagttgtacaccgtgacgaagaataatggaaccagaagaacagggattctttttaagcaggaggacagcaaccttgcaccgacgatctatctggaggaattttaccagaagtatctgaaggggcagcaggtaccggatctggcagattccatttgcagtatttatcaggagatacgggtgaagaaaacctgtgattgtcagaatctgtttgattttaatcatgtaaaagagcatatcgtgtacaagctgatccggcgggatgccaacgaagaactgttaaagcagattccttatgagccgttcctggatctggcagtggtctattatatccagatagacaacacacgctttggctcggcggcgatccagatccgcaacgagcatctgcggtactggcgtgtggaaaaggaagaaatccgctgtcttgccgagaagaatacaccgcggatctatccggtgcagatccggcagattgtgcgctttatgtatgtggcgacgaacgagcagtgcagtctgggggcagcagtgatgcggtatccggatttccgggaaaaggtcagggggatgatcagaggggatttctatatcctgccaagcagtatccatgaagtgatactggtgccggaaagctttggactggagccggagcggatgcaggaaatggtaaaagagatcaatcagaccggagtggcaccggaggaagtgctttcggattccgtgtattactttgatggggaggagattcggatcgtggcgaagtagggatagattataaacgtgtatagagtagggaaaattgacagggaaatataccattgtatagcagaggatatagtaacagatgaagtttccataaactgttgtgcagattatgcatattcgggaaagacatcccaatgattatgaacttttttctacatactttgacgagataatacgggatccggattatataattgaagcgaagaaacccaatacagcgttgatactaaaagaaattaaggacgttaaagaagtatttaaaatggttttacatttgattacatcaaaggataatctggactacaaaaattcaattatcacatttatgaaaatagatgataaggaatggaacaggctgctgcgcaacaagaaaattctttacaaaagagaataatattgatatactgaatgtagagaaaaatgcattcatatgattatctaaggtggaagatttcgtgcgatccacacgccgatggtatagacaggggaaacctgagagatgcaggagaagcgcacgcctgctggataatcatttgaagaagacttaaagaggtgtcgcaggtttgcggcacctttttgtgtatacgatgagccaagtgcagatttgtgcttgcacaagaatctgtattttgcgaatgtacatcacctggctgttaagcgagatggtgtacaaagtatacgaatcaagtaggagtcagcttacgtaatcatacaatagaaataaagaaaggaattccgagcatgaacacagaaattttagtaattgaagatgacgacctggtaagacagggaatcgtagacatcctggaactaaagggatggaatgcggttgcagcgaagtcttgtagcgaagcactcgtaaggattcgaggagaagaatatatgctgtatgtactggatatgaagctgccagacgggaacggaatcatgctctgcagggagatccgcagatatacagacaatcccattcttttcttattagcctatgacagtgaagaatttatcgtagaaggatttgaagcgggagcaaatgactatgtgatcaagcctttccgcacatttgaatttattgcgagaatcaaggctttgctgcgacgtaccggtatgcaaaacggcaagaaagtaaaaaaaggaatcaaaagcggagaatatgaactggatttgcagaagcagattttgcagaaggatggtgtccgaatcgatcttacaaggaccgaatatcagattctgtgcagccttcttgcaaacgcaccgaatcttgttgcgagggagttcctgttggacacgatctgggatttcaatgaaaattatatcgatgacaataccttgtctgtacatatgaaccggctgagaaagaagctgactgcagaaaatgagcaggatccgattgagacaaagcgtggagtcggttatgcatggacgctgaaagctgaggatgtgtatgatgagatctgagagaaagacggagaaatggagaataccgggaaaatggactctgatttttcttttgatattgctggctttttatggataccagaatattcttgcagaaaattatgaaagacaggttgtttcctggatcggacagacagaaaaagacagaacggtttctgcctttacagaaccggatgaagaagcatatcagaagggctgcgaggcattgaaagaggcagggtatgaagagacaggaaaaatctggctggaaaagagaatccgaagttacggaataggtgtgtttgtggctgcgatcggcatcatctgcattgttggtctgctgacagaactgcacatggagaaaagacagaaaaaagcactggataatcaattggcagaaaaagacagggaactggaagcaaagctggcggaagaaaaagaatttctgcatcgtgaccggcagaaaatgggaacttacatggaaaatatttcccatcagctaaaaacaccgatcgcgggaacacttctgaatctggaggtgcttcttgtgacagaagaggatgaaaaacggtatcagaagctggaagactgtgtgaaaaaggtgcaatggatgtccgatatgacgatcgtgcttcttaggcttgcgcagattgattccgggaaaatctggatgaagcggaaaaaagaaaatctgaccggactgatcgaagaatgtatagacagaacacagcctttagcggaagaaaaaggagttggatttgaaatggatgttccaaaagaatgcctgctttcctgtgacggattctggctgaaagaggcaatggaaaatgtactgaaaaatgccgtagaatatgcagatacaggaagcctgattcagattctgctgaaagaagatacggactattataagctgtatatcaccaatcggggaaaacggattgaagaagagaaaagagagctgatttttgaccgtttctaccagatggaacagggaagtggaatcggaattggtctgcatctggcaagggaaattgtcacgctccatcagggaacactgaaggttgtggatcgaagcggcttggaggaggcgacaaccttccagtttatactgccgaagatgatcgcaaaagatcatgcacaggaagaaataaatcttacgatttcgtaagattagggtaagtgaatcgaaagactgatctgatatagtaagactaacaaatgaaggaggtggcagaagatgaaaaccgtaatcagactggacaaggtaagcaaaagctatacccttggtgaaaagaaaatcacagcattaaaggagttttcttttgaagtgaaaagcggtgaatttgtggcagtgatgggacgaagcggatccgggaaatctacttttcttaagattgcaggaacactggaaaagccagatactggagcagtcttcctgaatggaatacagattaacgggctttcccaaaagaagatctgcaagatccggcagaagaaaatcgggtttattttccaacagtatcagttactgccggagtatacgatctgggataatgtatgcatgtcgctttatatcgcgcatacggtaccggataaagcttatatccgacagcttcttgaaaaggtcggattatgggacaggaacggagattatccggatcagttatctggtggagagcagcagagagtggcaattgcccgtgcaatggcagtaaagccgggagtgatccttgcggatgaaccgaccgggaatctggactatcagactggacaggagatcatgaaactgatctgtgcatccagagagctttaccgtcagacaattgtcatggtgacacatgatatggacagtgccaattatgcggacaggattgtgtatatggaagatggtgcattgcgatgaaaagagagaaaagacatggaattgaacgggaactcagtataaaaagaatccgcagccagaagaaatacagtatcctgatagtctcagtcctgcttcttacctgcacactgattcagattggttttcagatgtcggaaggactgaaagccgcatatatcgagaatcgtaaagcagtatatggggagtgggaacaggtatttttggatatggatgaaagctcggtaaaagtggcagaagagaatccatttcttgcacagaccgggaaaataagtatctatggggcgatcgccggagattatctggaaaaccgtcagatgaatatcgggacaatggacgagacggcgtggaagcttggcagactggaaatgaaagaaggacgcctgccggaaaatgagcatgagatcgtaatggaatacagtacacttcgctcacttggatatgaggagatgcttggaaaagagattacactggatattacaccggcgctttccattctggagcagggggaatcaaaaagctattcgtatactttatgcgggatcctaaaagattatcagataaactgggaaatctgcaaccggcatcgttttccaactggaattgtgacacaggaaggcgggaacaggatcggctctgttcaggatatgcatatgcttgtaaaagcgaaagaaggcagtgaaagtgtttataaagatctgaaagacagcgaagaatttacctgcggcatggatgacaatgtggaacaggacaaactttctgatgtaagtcttccgtatatggattttctggaaaatatccgtttgctgattggtggtgcgtcgatctgtatcctgtttcttacggtatcgcgttcgattatctcaagagaacagttctggaggttcctggatgcatttggaatgagaagagggcagatgtaccagattattttctgggaagtagttctgtttggcattggggctgttgttgttggaaatcttgcagggattgggatttaccagctggttatccctgcttttgaaaagataaccgagcagacattaccacaggcggttgcatgggaaggagttctttttggaattggattcagtgtgttatgcattggggcaagttatggactcagtgcagtacagcttcgcatacttctgaaagaaaaaaagaagaaagttcagaaaagaaggggaaagtacaggaagatcgtccggttcacgccgggaagagttttacttcataaatggcagatgcatcgagtgcgtaagagtgtagaaattgttcttctggcaagtgctttgctgatcgtgggatttggaaagatggaaatatcaaccagacaggaagaactgaaagtatatcaaaggctgacaggaaatggatactatttgagtacaatggagattacgaattctccgggaatttccaggcagacagttgataaactggaacaggttgccggagtaacttctgtagaacaatatcataacaatgaaaaagaggagttctggattgatctgtcagaatatgctgaaagcgagtattttcagaaagtagtcgaaacattggtggcatatctgaatgagacatcaatcaaggaaaagatatctattgagaaagtaagattgtctttgcttacaatagacagatggcaggatatacagcgttttctgagaaatctggatgaaggcagcctgacaaaagaagaatttgaacagggagatttttgcattctggatcttacagagttgcaggaatatgacggaaaatatctgagtgcattcagcccggacggacaaggaatatcagaagatacggtacaggttggtgatgaacttccggtttatacattgaatgagaatggaagtagaaacgaaaatccgattccagtaacagcgattttacgtggcatgaaggaagaagatgtgcggaatccacagataggtggatctggtatatcgatgattgttggaaagaatttctggaagaaatttgggaaaagcagaattatggaatatgatcagattgtaaaaattctggtatcggatgatgcggatgcgtatgatacggaagggcatattctaagtattttaaaacagggaacagctgtaaatgtgcagaataaccatgaagagtataagaaaatacgtcaggaattatattcctttataggaatgtacagcatttttgcagtgttttacatgattctgatttccatagttttgtatcagatgtttcttgcggagaagcaggaagaaaaaagagaaggggaaatcttacagtcacttggaatggaagaaaagttcctgaagaaaatgcatcggatagaagttctttggatgacgggatgcgcaggagtgattggagtttttacgttatggggtgcttgccgactgatatagaggaggcttcaagatgaagaaaacctatatcctatattgctgcataatcagcgttattctaatgccgttcaaatggtttgcaccggagaatatgacggatttatcggaatggggatttaagtgtatttccaatccggttggaatcgtgttgctcattattggtgttctgctgattcaggcaaaacgtatagaagcaaaagaacggattcaggtgggaattggattagtggcaataaaaaagactgtcaagccataaaagcttcacagtcttttcacgtccctgatcagaatcgaactgacgcacccgcctccggagggcggtgctctatccactgagctacaaggacatttactaatatagcacttgcccagaaaaaaatcaagaagaaatttcgaacaggacaagtaaaacgggatgaacagaatagcagccgaaataccatttgaaagtgatttgatacacagagtgggcatcagcataaagcaattttaatgcagaaaaagaataaataatcgcttcgacaaaaccagtcaaaacaagtcttccttcgctattgacgcaaaagcgggcattgcgtatgataggtggcaaaggaggaaatgccatgtcggaagaaaaaaggatgcccgtccttacaggtcaaaagaagcagattttctacactggtcttgtgtatctgctggtctgctttatgacggcgggagtcaccgtttttcttacgaaagagaaaaaagatgaggtaaaagaagtaagtgcagttgttacagaagagccaaaagtaaataccggatacgcagcgatggaaaccaatccacttctggagaaccgggacgaagagcttgcggatgcagtagaagcatactatcaggaactttccggaaaagaagcctatgccgaagcatacgatgggattgcgatttacacgaaagacggtaaagcaaaaggcagcaggatcctgtatgtacggtacaatatgaagatccgtggaatttacactgaagtaccgggacttgaaaccttatatgcggtcaaggacaaagatggaaaattcgatattcaggcagagatctctgacgagcagattcagacgataattgaagaagtttccgcacaggcagatgtgcaggagctgtttgcacaggtagaagcggattatgaacaggcacttggttcagatgcaatgctcgcacaggcggtggaagatctgaaaaatgcagtggatcagtaacactgtaaatacagcgagccagtaacgtctgaaaaaagcggtaaagtctatgaaaaaatgttgtgcgtcagcagaagtggatgctgtcttgctaaaaattcataaagaatgcagaatttcaggcaacatccagtctccggattacgattttctattgcgcttacataaggattcagatataataaataaagcggcgcaggcaaagagtctgcgctaacgtttatgatgaaaaagagaggaacgatcgatactatgaagaagatcctggatctgattacagaagaaatggaacaggcatttgcagatgccggatacgagaaagaactggcgcgtgttacactttccaaccgcccggatttatgtgaatatcagtgcaatggtgcgatggcaggtgcaaaaaagtaccgcaaagcaccgatcatgatcgcagaagaagttgtggcaaagattccggagaacggatatatcagcggagcagaagcagttaagccaggtttcatcaacctgaagaccaacccggcagcagtcgcagattatctgaaccagatggaagcagacgaaaagctcggcgcggaagaagtagagaatccaaagacaatcgttattgattacggcggaccgaacgtggcaaaaccgcttcacgtcggacatctccgctccgcgatcatcggagaaagcgtaaagagaatcacccgttttatgggcaataaagtggttggtgatatccaccttggagactggggatatcagatgggactgattatcacagaactgaagaaacgccagccggatcttccgtattttgatgataatttcaccggagaatatccaaaagaagcaccatttaccatcagtgacctggaggaaatctatccggcagcgtccgcttatgcaaaagagcatgatgattacagagaagaagcactggatgcgaccttccagctgcagagcggaaagcgcggttaccgtgcaatctgggatcacattatgaatgtgtctgtgacagacttaaagaaaaactatgcgaacctgaatgttgaatttgacctctggaaaggggaatctgacgcacagaaatacatcccggatatggtggaaagactgaagaaggaaggctatgcgcatattgataacggagcactcgtggtagatgtcaaagaagagaccgataccaaagagatcccaccgtgtatgatcctgaagtccgacggtgcagcactttatgataccacagaccttgcaacactggtagagcgtgaagaactgttccagccgaacgaagtcatctatgtagttgacaaacgtcaggaactgcattttgtacaggtattccgctgcgcgaagaagaccggcattgtaaaagaggatacaaaacttactttccttggatttggtacgatgaacggaaaagacggaaaaccgttcaagaccagagaaggcggcgttatgcgtcttgagaacctgatccgcgagatcacagaaaagatgtatgaaaagatcacagagaaccgtacagtatcggaagaagaggcaaaagcaacagcgaagatggtcggaatggctgcaatcaaatacggagacctctccaaccaggcagcaaaagactatgtattcgatgtagacagattcacttcttttgaaggaaatacaggtccgtacatcctgtacaccatcgttcgtatcaaatcaatcctgaacaagtacaaagaatcaggaaagagtatggacgatatcaagatcctttcggctacaagtgagagcgaaaaggctctgatgctggaagctgcgaagtttggcagtgtgatggagaatgtatacgaagaacttgcaccacacaagatctgtgcatatatttatgatcttgcaaatgcatttaaccgtttctaccatgagacaaagatcctggcagaagaggatgaacagaaacagaagagctacattgcccttcttacactgacaagagacattttgacaacctgcatcgatctgcttggatttgaagcaccggaaagaatgtaaaaaggcagaagcatcagaagtaatgacaatacgataaagaggcgaggacatatgacagagaaattgttttacacagacagtcacctgcaggaatttactgcggaggttgtgtcctgccgcccgtgtgataacggatatgaggcagttctttcaagaactgccttttttccagaaggcggcggtcaggcagcagataccggagtgattgacgggatcagagtatatgatgtacaggaaaaaggagaacagatctttcactatctggaaggagaactggaagaaggaaagaccgtgaccggtcagatcgactgggacaaacgtttttcacggatgcagcagcacagcggagaacatatcgtatcgggaatcgttcatgcacgttttggatatgataatgtgggattccatttgaatgatgagctgtgcactctggacttaagtggtccgctcacgaaggaggagcttcgcgaggtggaaaatgcggcaaatgaagcggtatttgcaaatgtaccggttcagataagttatccgtccaaagaaaaattgaagacgttggattaccgcagtaagatagagattgacggacaggtgcgtatcgtgacgataccgggatatgacgtgtgtgcctgttgtgcaccgcatgtgtattttaccggagagatcggtcttatcaaactggtgcagagtcagaattataaaggcggtatccggatcactatgctgtgcggaagaagggcactgaaggattatcagcagaaagaagaaagtgtgaaggcgatcatgggaagcctttcagcgaaggaagaattgattgctgaagcagttgaacgcgtaaaagaggaatgtacacagctgaagagtgaacttgcagagacaagatatcagattcttgaagcacaggcagaaaaaattccggagggacagaaaaaggtctgtatttttgatagcaaattaagtgggaatgaaccacgtgagcttatgaaccttgtactgaaaaaaggaacagaagtatgtgcggtatttgcaggaaacgaagagagtggataccgttatgtgatcggcagtgagacagaggatgtgcgcccgtacagcaagatcctcaaagaacagtttgacggaagaggcggtggaaaaccggtcatggtacagggctctgtaaatggaagtgaagaggcaatccgaaaagtttttgagtaagagaaggcggagatgaagaatgcgagacaggaaaacagggagaattatctggtatttgttcagtgcggttctgatcaaatggggtgtggagatcgcagtagcgacatttgcactttcctgcggtctgcgcagcaatatgggaattggggcagtctcttcgatcatcacgatcccaatgattgcgtggatctaccggaaagatcagggacgctatgaaaagcagcaggaatcctggtggaaatataaagcggcttcccgatatggaatgtggcttgttatgctcgtcggtgcagtgactgcgtgtgtggcgatgaatgatatcgtcatgctgatgaatatgcagaggatcagccagatttatcagagcacagagcagatcatttacagtgcaccgcgttggcttcagctggcgggagccgggattctggctccggtcgcagaagagcttgtttaccgcgggatgatctaccggcggatgcgcgagagccttaccgctgtgcaggcaggtgtgtttgtagccattttgttcggtgtcggtcatggaaatctgccacagggactttatgcaatggtactcggacttctgcttgcctgcatttatgagaaattccggaatattgcagctccgatcctgttccatattgttgtgaatattacatcattattgctttcgtggtatgggggctttgaatggattctgggaacagagggaaaagcagttggaattactgtattggctacgttgatttctgttataatttatgtaaaaataaaaaatataagacaagaaatacgataattaactgaaaaatactgaaaaagtttacaaaataaataatatctgacaatttctgtaaaattaggggtttacttttgcagacaaatgctgtatagtgttaaatcataaaagcaacaacaaaaccgttttacagaaagggcaggttatatgagtgtaatacaacaaaatacagaacaaggcttatacagccctgattttgagcatgacaactgcggtatcggagctgttgtgaacatcaaagggcaaaagagtcatgatacagtcgcaaatgcgctgaaaatcgtagaaaatcttgaacatagagctggcaaggatgccgaagggaagacaggagacggtgtaggaatactgttacagatttcgcacaagttctttacaaatgtctgtcgtcccctcggcatctttttaggttctgagagagattacggtgtgggaatgtttttcttcccacaggacgaactgaaaaggaatcaggcaaaaaatattttcgaagtcattgtcgaaaaagaaggactgaaattccttggatggagggaagtgccgatccgtaaagagatccttggaaagaaagcactcgaatgcatgccgtgtattatgcagggatttatcgaacgaccgaaaaaagtaaaacaaggactggattttgaccgcagactttatgtggtaagaagagtctttgaacagagcagtgatgatacctatgtagcatccctgtcaagcagaaccatcgtgtacaaaggaatgttccttgtaaaacagctccggatgttctttgaagatctgcagaacccggattatgaatctgcaattgcagttgtacattccagattcagtacaaacactaatccaagctgggaaagagcacatccgaaccgtttcatcgtacataacggagagatcaataccattcgtggcaatgcagataagatgcgggccagagaggaaaacatggaatccgagcatctggaaggagagctttataaagtccttccggcaatcaataccgcaggttccgattctaccatgctggataacatgctggaatttatggtgatgagtggcatgccgcttccgttggcagttatgatcaccatcccggagccatgggcacagaatgcaacgatgtcacagaaaatcaaggatttctatcagtattacgcaacgatgatggagccatgggacggaccggcatccatcctgttctcagatggagatattttaggagccgtacttgaccgaaatggactcagaccttccagatattatatcacagatgatgacacactgatcctttcttctgaggttggtgttctggatatcccgccggagaagatcgtagtcaaagaaagaatccatccaggtaagatgcttcttgttgataccgttcaggggcgtgtcatcgacgaccaggaactgaaagaagaatatgcggcaagacagccttatggcgaatggttgaacagtcagttggtcaatttaagcgatttaaagatcccgaatcagaaagtaccgcagtattctagagaagaatgccagagactgcagaaagcatttggatattcttacgaagaagtgaagacttctattttaaatatggcaatgaatggaagcgaaggaatcggagccatgggtatcgatgcaccacttgccgttctttctgagcagcatcagtctctgtttggatattttaaacagttatttgcacaggtaacgaacccgccgatcgacgcaatccgtgaaaaaatcgtgacttcgacaacggtatatgtcggagaagaaggaaaccttttggaacagaaagaggaaaactgtcatgtactgaagatcaatgatccgatcctgacagataccgatctcctgaagatccgtaacatgaaagtcgacggtttccgtgtagcagaaatttctactacttattataaaaactccagcctggaaaaagcgatcgattatctgtttatccaggtagaccgtgcaatccgtgaaggcatgaatatcctgatcttaagtgacagaggtgtggatgaatatcatattgcgatcccgtccctgcttgcaacctcagcggttcatcagcatctggtaagaactaagagaagaacagaggttgccatgatccttgagaccggagaaccaagagaagtacatcatttcgcaacgcttttgggatatggtgcatctgcgatcaacccgtatcttgcacatgaatcgatcaaacagctgatcgatacagatatgcttcagaaagattattatgcagcagtcaatgactataatgaagctgttataagcggaattgtcaaaattgcatcgaagatgggaatttccacgatccagtcttatcagggatccatgatctttgaagcaattggattaaaaccggaattcattgaaaaatatttcaccggaactgtcagccgtgtcggtggtatcggactggaagaaattgcaaaagattatatggcaaggcattccgaggcctttgatccgctgggactttccgtagatctgacgttgaacagtgtgggacagcacaagtcgaagagcggtggtgaaaagcatctgtacaacccgagaacgatccatatgctccagcagtctacaaggcgcggggattatgaaatgttcaagcagtacacgcagatggttgatgaagaatccaaaggaatcacactccgtggacagatggacttcaattatccaaagaaaggagttccgctttcggaagtagagagtgtggattcaatcgtgaccagatttaagaccggtgcaatgtcttacggatcaatttcaaaggaagcacacgaaacccttgcccttgcaatgaatgcactgcacggtaagtcaaactccggtgaaggcggagaggatatcgagcgccttggaaccgacagaggctctgcaatcaaacaggttgccagtggacgttttggtgttacaagcagatatcttgtcagtgcaaaagagatccagatcaagatggcgcagggagcaaaacctggagaaggtggacatctgccggggggaaaggtttacccttgggtagcaaaaaccagacattctacgccgggtgtgggactgatctcaccgccgccacatcacgatatttactcgatcgaagatctggcacagctgatctatgactgtaaaaatgcaaacaaggatgcaagaatttctgtgaaactggtatctgaagccggtgtcggaacggttgcagcgggtgttgcaaaagcaggagccggactggttctgatctccggttatgacggaggtacaggagctgcaccgagaagttctatccataataccggacttccgtgggagcttggactttctgaaacacatcagacactgatccagaacggactgagagaaagagtccgtatcgagacagacggtaagctgatgagcggtcgtgatgtggcgatcgcagcacttctcggtgcagaggaatttggatttgcgacggcaccgcttgtaaccatggggtgtgtaatgatgcgtgtatgtaacctggatacctgtccggtcggaattgcaacccagaatccggaactgagaaagagatttgccggaaaaccagaatatgtcatcaatttcatgcgttttatcgcggaagaattaagagaatatatggcaaaacttggcattcgtactgtggatgaactggtgggaaggacagaccttctgaaagtgagagatgtgccgacatccaaacgtgccgcaacactggatctttccagaatcctcaataatccgtatgcaaaagagaagaaaggcatgatcttcaatccgaagaaagtctttgattttgaactaaataaaacactggatgaaagagttctggtaaaggaacttcttccgtcactggaaaagaaacagaagagaatcctggagctggatgtaaaaaatacagaccgtacattcggcacaatcttcggttctgagattacaagacgttatccggacggactggaagaagacagctatgtgctgaaatgtaagggcgcaggcggacagtcattcggagcatttataccaaaaggtctgacactggaactgaccggtgacagcaatgattattttggtaaaggactttccggtggtaaactgatcgtttatccgccgactggtgtgaaatttaaagctgatgaaaatattattattggtaacgtagcgctttatggtgcaacaagcggaaaagcctatatcaatggtgtggcaggcgaacgtttctgtgtccgtaactccggagcaacagcagttgtagaaggggtcggtgatcatggatgcgaatatatgactggtggacgggttgcaattcttggcaagaccggaaagaactttgcagcaggtatgagtggcggtgttgcctacgttctggatatggacagtgatctttatacaaaagtcaacaaacagatggttaatatcgaaaaagtaacatctaagttcgatgtatctgaattgaaaggtatgatcgaagaacatgtagcagcaaccaattccgagacgggaaaagaaatcctggatcatttcaaagaatacctgccgaagtttaagaagatcattccgcgtgattacgagagaatgctgacccgcatccttcagctggaagaaaaaggtctcagcagcgaacaggcaaaaaccgaagcattttatgcgatcaaagaaggaagataggaggcaaaaaacgtgggaaaagcaacaggatttatggattatgacagatgcgatgcagagtgcgaatctccaaaagagagaattaagcatttccgggaattccacacgcctctgtcaaaagaagagcaggaaatacagggcgccagatgtatggcatgcggcgtcccgttctgccaggcgggacagatgatcgcagggatggcaagcggctgtcctctgcataatctggtgccggagtggaatgacctgatttatcacggcaactgggaagaggcatattaccggctgaaaaagacaaacaattttccggaatttacttccagggtatgcccgggactttgtgaggcggcatgtacctgcaacctgcacggaagcccggtgacgactaaagcaaatgaatatgggattattgaaaatgcttacgaaaagggatatgcaaaagcatgtccgccgaaagcgcgtaccggcaaaaagatagcgataatcggttccggaccttccggtctcacagtcgcagatcagttaaataaacgaggacatctggtaacagtatttgagcgggaagataagccgggtggacttctccgctatggaatcccgaatatgaagctggaaaaacagttcatcgaccggaaacttgcagtaatggaagaagaaggcatccgttttgaaactggctgcaatattggaaaagataagaaatctgtagaacttctgaaagcgtttgaccgggtggtgctttgttgcggtgcattccatccgcgtgatataaaagtacccggaagagatgcaaaaggaatttactttgcagtagatttcctgaaatcaactacgaaatgtctctggaaaaatgagatgcagctgaaagaaggcgaatatatttctgcaaagggcaaaaatgtaattgtcatcggtggtggcgatacgggaaatgactgtgttggaacgtcgatccgtcatggtgcaaaatccgttcttcagctggaaatgatgccgaaacttccggatgagagaagcgctatgaatccatggccggagtggccgagagtctgcaagacagactatggtcagcaggaagcaattgctctctggggacatgatccgagggtttatcagacaacggtaaaggaatttgtcaaagataagaatggaaatctttgcaaggtggttcttgtgaaactggaaagcaagaaggatgaaaagaccggacgtatgatgatggcagaggtcgcaggaagtgagtacacggtaaatgcagaattggtgctgatcgcagcggggttcctcggaagtgaggattatgtgacaaaggtattcggtgtggaagtcaatgagcgcacgaatgttaaaacagctccgggtgagtataaaacgaatgtgccgaatatatttacggcaggagatatgcacagaggacagtcgctggttgtgtgggcaatccgggaaggaagagaagcggcacagcagatagatctggatctgatggggtatacgaatctgtcagtacagtaattagtggcgtttgattttatgaaggcgtagcccgccgcaaggtgtaggaagtggttcctgcaccttgcggcgggctacgcctttaatgaaaatgtgcaatagatttatttttcaggtacgatttctaaccagtagccgtctgggtcttcgatgaagtagatgcccatggactcattttcgaaacagacgcagttcatttctttatggtgtgcgagggcggcatccatgtcgtctacagtgaaggcgaggtggatttcgttgtcgccgaggtcgtatgggcggtccatgtcgcgaagccaggtgagctcgagctgatgaacggagcttccatcaccgaggtagacgagcttaaaacttccgtcagcagcatctttttcgcggactacggtgagtccgagtgcatctttgtagaattgaattgatttttcaaggtcacgtacatttaagttgttatggttgaatttgaaattcatagtggaatccttctttcttatttagtattctagatttattgattatgaagtcagtttagcataaataataaggattacgcaaggaatggttattaggagtgataacgaaaatatcagtatattatgataccctagtagaatattacaaaaatgttaaattgtattgcaaaaaatagaaaaatggtatataatcgaccacagggttaggaaaataattagtaaaaaatataggatgggtgattatgataaaatttaaacaagtatttttggcatctgttcttgcaagttcaatggtagttacgccagtatttgcagatgatgtcagcaatctgcagaatagtaaaaatgcagcacagagtgaagtgaattctcttcagtcagaattgcagacactaattgaaaaaatgagtaagctggaagatgatctggtgtcaacaggtcagcagatcacacaggcacaggatgatcttactgttgctaaagaaaaagaacatcagcagtacgaagatatgaagaagcgtatcaagtatatgtatgaagaaggcaactcgactgcgattgagactctgatcagtgctgagaatttctcagatttgcttaacaaagcagagtatgttcagaacgtacatagttatgacagaaagcagcttcaggaatatattgataccaagcagcagattgcagatctgaaagcacagcttgaagaagatcaggcgaatctggagtctatgcagtctgattatgaggcagagcagacgacgctgagtaatacgctggaatctaagaaagaagaagtcgcagatctggatcaacagcttcaggcagctgtagcagcagctgaagcaaagaggcaggcagaagaagctgcaaaggcagcaaaagcagctgagtcaacaaagtcaaattcgaccgttgcatcgacaagcaacagtggttcacagactgtaggtaatacaacaaataacaataataacaacacaaccgttacaccgagtgcaccaagtacaccaagtacaccaagtaccccgacagtgactccggatacaagtaataataacagcagtagtgataacggtggaagcacatatggcaacggaagcgctattttaagtgcagcagcagcataccttggagttccttatgtatggggcggtacttcgggaagtggtgttgattgttcaggtcttgtatacctggcacatcaggcatgtggtattccaattacacgtaactcatacagtcagggaagtggcggacaggcagtgtcagacccacagccgggtgatgttgtatgttacggaggacatgtgggaatctacgcaggaggcggacagatgattcatgcaccgcagccgggtgaggtcgtatgttatacaagtgttgattatgcataccactggtatagaagatactggtaagaaacgaagtaactgaagtaagtaaaaaaaatttttttgcggaaatcgaaatcaaaagtaaaaaaatttttttgcagaaatcgacgaaaacgtacataattccatgagaagttaaatgttgatttttgatgaaaaattgaaaaacgtacaaaataaaagagattttcatttggcatatgtcatttgaaaatctcttttttgaaactatttcatttacattagaaaaatttcttttttctgcgacgtcctttgcaataagggcaggattcacgatgtctcttctgatagaaaactttatcagctggacttaacggatatttgtgttcagaacttcttttacaattccaccaaaccttttgtgaatatgtatctaatattccatcgggatttacaaggcaatagtttgcaataaaatcccaatcttccattaaatcaggatgaagcgcggcaaaggatgtttttccaggaagtgctttacgaccagaacaataagggcaatcggcaacaccatttataacatcgataatccgagcaggataattttcacgacaagtgggacaagtccaagtggctatagtggtatttggaagtacctggttaggtgatagttcattctgatcggaccatagattgacaatatcaggatatttatcggctaaactattaaatccagaaagtaattttttattattacaataaggacattccgcttcaccatttattacttcaataatccgagctgaataatcgccatgacaggtagggcaagtccaagtggccatattggtattaggaagaacttgatcagccgaaagctagttttgctttgaccacatttttgcaatatcagggtgtttaacagccagactattaaatccaggaagaagttttctgttattgcaataaggacaatttgtttcaccatttacaacttcaataatccgagctgaataatcaccgtgacaagtagggcaagtccaaagtgcataattaacattgggaaaaacctgatcagcagaaagtttattttgtgttgaccatatgttagcaatatcaggatatttagcagccagactattaaatcctggaagaacttttctgttactgcaataagggcattctactttgccatttattactttattaatccgagcaggataatccccatggcaagtaggacaagtccagaatgccatagtggtattaggaaggatctgatccgcagaaaattgatttttgtcggaccacatagcagcaatatcaggatatttggtagccagactattaaatccaggaagtagaaatgttaaatgtttctgattgcctttatttttcataattatctccaatctgcacaggcaggcaatcagctgcaagtacattatacggagtaatgattatcaaagacaatatggcaaatatgtgtgcaaaagtaacttcgacctatatggaatttactcttgcatttggtccaaaaccggaatttagtttttcatttaagttttctccttcctctgtaggtgggagatgaattgcacaaaaataaaaagaacacttgttcgataacgaattccgtggtataatagagtcagtcgaaaaggtcgaaaacatagattattagagagaggactgatttgaatggaaaaaatagatcataatgcacattcagtgtatctgatgtattcagagagaaactttggaaagaagccttttggagtcagagtttctgtctgttgacagctggaggcgccccagtagaagtaatccgtcaatacattgaaacccagggagagaagaagtattgaacatagcatatcgtttccgaatttatccgacagaagaacagaagatatttcttggcaaaacatttggctgttgtcgttttctgtataatcagatgcttaatgataagatccaggagtatgaaaagacgaagaaaatgttaaaacatacaccggccatgtataaaaaagaatatccatttctgaaagaagtagattcgctggcactggcaaatgtccagcttcatctggaaaaggcatataagaatttttttcgggatcccaagattggatttccaaggttcaaggcaaaacatcattccagaaacagctatacaacgaatgtggtcaatggaaatatcctggtggaaagtaagcggatccggcttcccaaattaaaatggattgccatgaaaaaacacagggagccagcagaaggcctttgcctgaaatcagtgacagtcagtatggaaccatccggcaaatactttgcaagcctgctgtatgaagggtacagttgtgaaaaccaagcagctgaaccagattatagtaccgcaaggatacttgggatagattacgcaatgcagggtatggcagtattttcagaaaagattgagacagaagaagcaggattttttagaaaaaacgaaaaaagactggcgagggagcaacgaaagttgtcaagatgcgtacgaggaagtcataattatgagctgcagaaaaagaaagttgccagatgtcatgaaaagatacgaaatcagagaagagattatctgcacaaactaagccgaaagattgcagacggttatgatgcagttgcagtggaagacatcgatatgaaagcaatggggcaatgtctgcatttcggaaaaagcgtacatgataatggatacggaatgttcagggaaatgatagactataaactggcgtggagaggaaagaaaatggtaaaggtagaccgtttctttccttctagtaaaaaatgctgtcaatgtggaaggataaagaaagagctgaaattatccgaaagagtttatcactgtgtgtgtggaaatgagatggacagagaccgtaatgcagcaatcaacatccgtgaagaggcaagaaggatgttgacagcataaactgtccgtatccggacaattggatcataagaaaacatgcccgtgtccgggcaaaagaatcgcggggcacgcgaggatagcttgtagatacttggctcagtagagccattgagcaagaagcccccacttcaaaattagtgatttaagtggtgggagcatgtcacgttaacgaattacacggcttgcgttgattaagagtgataagaaaatgacctgatttatttatacaaaaattggtatagataagttgggtcatttattgtgcagtatatttgattatggtaatataaagatatgaattttccaaaagaaaagagaatgaaaatgaatttaacagagaaatactggaagaaattgtatggacagataacaaacaaagatttacttttaatgaagataaaacaaagatacgggcaaatcagggacattcgattcctgttgatgtagaattaccagcagcgataccgcctgaaacgctctggcatggaacgggagaaaaatatgttgcatccattgatcaacaaggattgattccaaagggtaggttatatgtgcatttatcatcagacgcagctacagctacgaaagtcggttcacgtcacggaaaaccagtgctttatatcgtaaaaacaaaagaaatgtatgacgatggatattcatttttcttatcaaaaaatggagtatggttaacaaaagaagtccccgtaaaatatttaatcaaagaggagcagtaaggatgatttatgtaaccggcgactgtcacgctgattttaccaggttcaatactaaaattttcccggagcaatatgaaatgacaaaagatgattatgtcattatctgcggtgattttggcggagtatggaatcgctttgaagaaaataaacatgagaagcattggatggactggctggaagatcgtccttttacaactcttttttgtgaggggaaccatgagaattttgacaggctttacagctatcctatagaaaaatggaatggtggaaatgtacataagattagaccttcggtgatccatcttatgcgaggacaggtttttcacctttgcggaaagaaattttttgtattcggcggagcaaaaagtcatgatatagacggtggaattttagatccggaagcactggattttaagaagaaaaagaaaaaactggataaggaatggctgccgtatcgtgtgaatcacatttcctggtggaaagaagaaatggcttcaaatgaggaaatggaagaaggattaagaaatttatctcagtataacaatgaggtagattttattatcagtcattgttgtgctacaagtacccagaaacaatttgtagataagactttttcagcagattccatgacggattatctggagttagtgaagcagcgggtaaatttaaagaagtggttctttggtcattatcatgataataagaatattggactgaaagaaatactgatatatgagcagattattcggatactgtgagaaattataatttgtgtatgacgaagggagattttcgacatatgtgtaaattgatggaagaatatgagaaacgtacactgaaccggttcgtgaaaaaacttactgttccgggcgaaaaatgtaatttgaagatgcggatgaatctgcgctatgcatgtttcaaatttctaagtatgtaaaaagaatcacttatcagaaaaataaaacaacaggaggaaactaaaaatggaagtaatacgcgcaaaaagtgccggattctgctttggtgtaaaacgcgctgtcgatacagtatatgagcaggttgaaaaacagatgggaaaacagatctatacttatggtccgatcatccataatgaagaggttgtaaaggacatggaagcacatggcgtaaaagtcgtgcacagtgaggaagaactgaaaggtctggaagaaggactggtgattatccgctctcatggtgttccaaagagaatctgtgacctaatggatgaaaaaggcatcgaatatgtagatgcaacctgtccgtttgtgaaaagaatccataagattgttgccgaagaaagtaaaaaaggcagccggatcattatcattggtaatccggatcaccctgaggttgaaggaatccggggctgggcaggagaaaatgtaaccgttataaaaaatgcagaagaagcagaaaaatttgaaaatactacatccgaaagaatttgtattgtgtctcagacgacatttaattacaataaattcaaagatttagttgaaattatttcagaaaagggttatgatataagtgttttaaatacgatttgtaatgcaaccagagagcgtcagacagaagcaaggagcattgcaaaagaggtggatgctatgattgtaatcggagacaaacatagttccaatacccagaaactgtatgaaatatgcagcagggaatgtcacaatacgtactatatacagacacttgacgattttgatatgaatcaattaaggtccgtggaaacagtaggtattacagcaggggcatccacgcccaacaatataattgaggaggttcaaaataatgtcagaattaacttttgaacaaatgttagacgagtcatttaaaacaattcataatggagaggtcgtagatggtactgtaattgatgttaagccagatgaaatcatcttaaatataggatacaaagcagacggtatcatcaccagaagtgaatataccaatgataacagtgtagatcttacaactgttgtttctgttggtgatccgatgactgttaaagtactgaaagtcaatgatggagaaggacaggttcttcttacatacaagagacttgttgcagaaaaaggtaacgaaagattaaaagaagcattcgagaacaaagaagtcctgaaagcaccggttactcagattcttggcggtggattaagcgttgttgtagatgaagcaagagtattcatcccggcaagtcttgtatcagatacttacgaaaaagacctttctaagtacaaagatcaggaaatcgaatttgttatcagcgaattcaatccaagaagaaaccgtatcatcggtgacagaagacagcttcttgttgctgaaagagcagaaaagcagaaagaactcttcgctaaacttaaagtcggtgatgtgatcgaaggaacagttaagaacgtaacagatttcggtgcatttatcgatctcggcggagtagacggacttcttcatatctctgagatgtcatggggaagagttgacaatccgaagaaagtattcacagttggtgaaactcttaaagttcttgttaaagatatccatgatacaaaagttgcactcagcttgaaattcccggagacaaatccatgggctaacgcagctgagaagtacgctgtaggtacagttgtaacaggaaaagttgcaagaatgacagactttggtgcattcgtagaacttgctcctggagtagatgcactccttcatgtatcacagatctcaagagcacatgttgaaaaaccttcagacgtactttctgtaggtcaggagattacagctaagatcgtagatcttaacgaagctgacaagaagatcagccttagcatgaaagcacttgaaaatgcagaagctcaggaagaaactgaagaataattaaataagatatacaaggatagagactgattgaagtctctatcttttgtttgaaaaaaactggtagacataactaactacagctgaaaaaagttttcggatccataagtgatctcgataagtaagatgaaaaattttaccgaatagtcagaaaattcacaaagagaggtcgtagtagcctctcttttttgtgtaaggagactattgtgttaaaaaaacgacaagatgtactggaaaatatacaataaaatgacgaaagttactggaagtgtaggatttattttagtatatttataagagagaaaataggaaggaaggatatcaaaatgggacttttgacatttaaaggcggagttcatccgaacgacggaaaaagtcttgcgaaagacaaggcaatcgtagaacttctgccacagggtgatcttgtatacccgttatcccagcatatcggagcaccggctaagccagtagtagcaaaaggtgaccatgtgcttaaagggcagaaaattgccgaagcggggggcttcgtgtctgcaccgatctatgcatccgtatcaggtactgtaaaagcgattgaaccacgtgtgaatccgacaggttctaaagtgaacagtatcatcattgcaaatgacggtcagtacgaagaagtagaatatccacagccaaaacctctttctgaactgacaaaagaagagattctgaatatcattggagaggctggcgtagtaggtatgggtggagcaggtttccctaccagagtgaagctttcaccaaaagagccagacaagattgattatatcattgcaaactgtgcggaatgtgagccgtatattactgccgattacagaagaatgctggagaatccggaacttctggtagaaggtatgcgtgtgatcctgaagctttttgacaatgcgaaaggtttatttgcaatcgaagataacaaaccggactgtatcgcaaaattaaaagagctgaccaaggacgagcctcgtatggaagtcagagagatgatgaccaagtacccacagggcgcagaacgtcagctgatttttgcaaatacaggacgtgcgatcaattctaccatgcttccggcagatgctggatgtgtagtagacaacgtagagaccatcatcagcatttacaatgcagtagtaaaaggcattccttctatggaacgtgtcgttactgtaacaggggatggagttgtaaatcctggtaactacaaagtactcttcggaaccaaccagaacgaactgatcgaagccgccggcggactcaaagaaggctgtgaaaaagttatttcaggtggaccgatgatgggatttgcgatgtatacgacagatacaccgatcaccaagacatcttcatctattctttgcatgtcaaaagatgaagtatcagcctgtgaaccgacagcatgtatcaactgcggacggtgcgttgacgcctgtccaagccgcattattccgtcaagactggctgattttgcagaacgccatgacgaagaagcgttcctcaaattcaatggtcttgaatgtgtagaatgtggatcctgcagttatgtatgtccggctaagagacaactgaagcaggcaatcggatcgatgagaaaaaccgcacttgccaacaaaaagaaaaaatagaatagagaggaagaggtgaataaaagtgagtgaacagttaaaagtatcatcttcaccacatatccgttctaaagagacaaccggcaatatcatgctgtgggttatcatcgctctgttaccggcaactttctttggaatttacaacttccgtgacacacatgcatggctgcttgttattgtgacaacagcagcagcagttcttacggagtacatttacgaaaaactgatgcataaaaagattacgatcaaggatttcagtgccgcagttacaggacttctgcttgcactcaaccttccgccgacagccccgatctggatgggaatcatcggaagtgtattcgcgatcctggttgtaaagcagctctttggcggattgggacagaacttcatgaaccctgcacttggagcaagatgtttccttcttatttccttcacaggaagaatgacaagcttcgtatatgacggcgtatccggtgcaacaccactggcaacgatccgtgctaatatcgaagcaggaaatgcagcacttgacggtgtgaacagcatggacatgctgatcggaaatattgccggaaccatcggtgagacatccgttatcgcaatcgtgatcggagcgatcatcctgatcctcaaaggaatcattgatcttcgtatcccgggtacatatattgtgacatttgcacttttcatcggaatcttcggtggatttgtagatggaattggattcttcaatgttcagtacatgacagcagaactctgcggtggtggtctgatgcttggagcatggtttatggcaaccgattatgtaacttccccgattaccaaaaaagggcagatcgtatatggtatccttcttggatgtctgactggtctgttccgtctgttcggtggttcagcagaaggtgtatcttatgcgatcatcttcagtaaccttcttgtaccgctgatcgagagagttactcttccaaagcctttcggtaaaggaggagaaaaataatgaataagattatcaaaaatacactgatccttgcagcaatcaccgttgtatccggtctggtacttggagctgcttacgaagtgacaaaaggtccaatcgcacagacacaggcaaagcagaaacaggaagcctgtcaggccgtttatccggaagcagattcctttgaggcaatggacgtagatcagaaagctgccaaagaagcaatcaaaaagatgggaacgaatgcaacagtagatgaagtctattctgctgttatggatggaagcgaagctggttatgttataacagtaaccgacaaagatggttacggcggagatatccagattacagtcggtatcatgagtgacggtacggtaaatggcatttctttcctttccatcagcgagacagcaggtcttggtatgcgtgcgaaagaaccaagtttttacaatcagtttgcaggacagcaggctgaaaaattctatgtatccaaagatggcggagacggacagccgatcgatgctttgagtggtgcaaccatcacttcccgtgcagtcacaggagctgtcaacacagcacttggatattaccagacagcgttaggaggtagtggaaatgaataaatgtacagaaagactttataacggtcttgtaaaagaaaacccgacctttgttatgatgcttggtatgtgtccgacactggcggttacaacatccgcaatcaacggtattggtatgggactttctaccacaatggtattgattttctcaaaccttttgatttccatgctgcgtaagatcattccggattcggttcgtatgccggcatttatcgtagtcgtagcaacacttgttactgtggtacagttccttctggaaggttttgtacctagtctttatgcatcacttggtgtatatattcctctgatcgtagttaactgtatcatcctcggacgtgcagaagcatatgcatcaaagaacccggtccttccatctgtatttgatggtattggtatgggacttggattcacacttggtcttacctgcatcggtatcgtcagagagctgattggttccggaaaattattcggatttcaggttatgcctgatatctatgaacctgttactattttcatccttgctcctggtgcattccttgtccttgcattccttgttgcggcacgtaacaagatcatgaagaaactggaagcaaaaggaaagaaagttgtcaaagcgcagggatgctgtgaaggcggatgtgcttcatgcggcggatgcgacggacacgtgttcccgacaggtcaggaaaaggaataggagggagataagagatgaaagaattacttattatagcagttggttcggcgcttgttaacaacgtcgtactcagccagttcctcggtatctgtcctttccttggtgtttctaagaaaattgagacagcagccggcatgggcggcgcagttgttttcgttatcacgattgcatcctttattaccggtgcaatctaccagttcatcttacatccggcaggatttgagtatctgcagaccatcgtatttatcttggttatcgcagcacttgttcagtttgtagaaatgttcctcaagaaggttatgcctccgctttataatgcacttggtgtatatctcccgttgatcacaacaaactgtgcagtacttggtgtatcactgaactgtgtaacaaaaggatataacattcttgaaggtgttgtatacggattctccacagcagtcggattcacgatcgcgatcgtgatcatggctggtatccgtgagaagatcgaatacaacgatatcagtgagtctttccagggaactccgatcgtactgcttactgcagcactgatgtccatcgcgttctttggattctcaggaattatttaacagaaggaggaccgtgttatgagtataacaggagtattgattgctgcacttatcgtaggcggtaccggcgtattcatcggtgtcttccttggaattgcaggcaagaaatttgcagttgaagtagatgaaaaagaagaagcgattctcgcagaacttccgggtaacaactgtggtggatgtggatatgccggatgttccggtcttgcagcagctatagcaaaaggagaagctccggtcggacagtgtccggtcggcggtgctccggtagcagcaaagatcgcagcgatcatgggcgaagaagccggtgaaagcgtacacgaagttgcatttgtaaaatgtgcaggaacctgcgaaaaagcaaaacaggcatatgattatacaggaattacagattgccagatggcagccatgatgcagaatggcggaccaaaaggatgttctttcggatgtcttggtttcggaagctgcgtaaaggcatgtccgttcgatgcgatccatatcgtagacggaattgcagtagttgacaaagaagcatgtaaagcctgtggtaaatgtatcgccacctgtccaaaacatctgatcgagcttgtaccatatgaacagaagcatctcgtacagtgcagctcaaaagataaaggaaaagacgttatgagcgtatgttccgtaggatgtatcggatgtaagatgtgtgaaaaagtatgtgaatctgatgcagtacatgtagtagataacatcgcacacattgatccggaaaaatgtacaaactgtggaaaatgtgcagagaaatgtccgaagaagatcattaagtaaataaataatgaaaaaaaggatccggatgctgtttcggagcctgagaacaagtttttcttaggcttctgcaaatgcatccggatccttttttattgagttcattcgactgcggaaggatgaaaggatggaaagagaaagttagaaaaatttaatttttagaatatcgtggggtatgttataatagaaaaaatggagaaggaaaagaaaatttattggttgacggttaggtggaaaatcatccaaaatagaaatgaaaatagagacaaaatacgacattgcatcatctgtaaatattggcgcagagtatgacaagggcgtgaagaaactccttaagagcaaagagatcattgtgccgattatggagatggtgattccggaatttgaagggtgttcgcaggaagagattctgaattgtctggatctggcatcgattacatcagatgaggttgtcagtgacgcaccggtttcggagacggatgaatatcggatacggggcgaagatgcagggatatttgattatcttaatcaggtatttgtgggaaatatagaagaaatagagacttattcacatattgaatgggaagatgaatttaaggaggatgtggctatgacgatgacagggtttagtgatatattagttagaagagggagagaagaaggcagagaagaagggcgagaggagacaacggttaaatttatctggagtttacatgaaatggattttacagatgatatgatttcggaagcagtaaaaagaccgattgattatgtgcaggatattttgaaaaaagatgcacctcaataagaaagttgggaacacttttgtgaaaaatagattaatagcaggaataaagatgcttttacaggacttatggaatatccgcattgcgattcttgtatttgcaatttattttgttataggaagaaagtttttatacagtctgtgtcccatggtgatcatgacgggatttccttgtccgggatgcgggcttacaagagcgatgtttatggtgctgcgaggggactttgccggggcatggaaaatgcatccgtttatttatggtgtgattattctggtgggatggtttggcgtgcggagatacatacagagaaaagaaacgaagagtcttgggaaatgggtgattcttctgtgcgtaggactgattctatattatgtgtaccgaatggtaaggtattttccgggagatgctccgatgagttattactatggaagcgtgggataccgggtgtgggagataattagaagtggaagaaattatttatagtagagtatataaaagtgccgcgaagtcatcaaaacgatgatagagcggcacttttttggattatttacaaaagatactatggaacctttttgtgcagaatcagcaggagacagctttatgggaatagcgacactgactaatttatgtcttcccgcgctaatcctagcgcaggaagcctctcagcattttttctttccagaaccggtacttctgataccgtatcggcagatccatccaggttttcttatcgactatgcttctctgatgtgtgaagcagtcaaatccttcttttccatgatagcatcccatgccgctttctccgacaccgccgaacggcatctggctggtggcgaggtggatgatggtatcgttgatgcagccgccgccaaaatgacatctggcaaggactttctttttggcagcaggatcttcggtgaaaagatagagtgcaagcgggtggggatgggattcgacctgccggattgcatcattcaggtcagaataggtaagtaccggaagaatcggtccgaaaatttcttcgcccatgaccggatcgtcccaggtgacatcttttaggatggtcggggcaatgcgcagggcagacagatcggactcacctccacagaccagcttatcggcagcaatcaggttctgcagccggtgaaaatgtttttcgttgatgattttcccataatccggattttgaagaggctgtttgccaaactgccggtggatttctttttccagtgcctgaagcagctggtttcgaacagaagcatcgcagaggatataatccggggcaacgcaggtctgtccgcagttgaggtattttccgaatatgatccgtcttgcggtgagagaaattttcgccgtggaatccacgatgcacgggcttttcccaccaagctccagagtgacgggagtcaggtattcggcagcatgacgaaggacttcttttccaaccgtttttcctccggtgaaaaagattttgtcaaaacgctggtttaagagcgcctgattttcttcccggcctccggtgatcatcgttacatattccggtggatagcattccttgagaagctgactcagaatctgactggtgtgtggagcgtaagcgcttggcttcaggatgacggtatttccggcggcgagcgcatcgatcagcggttctaaagtgaggagtaccgggtaattccagggactcatgatcagtacggttccgtagggggatggcgattgaaagcttttggcggcgaactgtgccagcggagtagggacggttttacagcgcatcagctttggtaaatgcttttgcatccaggtaagctcggaaagcgtcagaccgatttcacacatatagctttccatccagctttttccaagatccgcttttagtgctgtgtacagatcttgttcatggcgtttgagtgcaagttttagctgttctaattgttttaatcgaaaagaaagcggaagtgttgcgccagttgcaaaaaaatcacgctgcgtggaaatccgctgtctgattgtctgttcatccatgtgttttaacctcctaggtatctggatatttaagtttcgattcctgttttccaaattgtgtttatattcttgaagagtcttttatactgaaaataatgtatatttcttttatgataacgaaaataagggaattcttcaacggtgtgagtggcgaaaatggaaagaatgtgataaaatatttttgtttgcagcagcagacttacataattttatcaagacaggagttttaatatatatgggatacgagcgtttggaaaagagtttaatcgatctggtaaaggaagagcaggcaaagctcggatatcggaaagagatgatccggctttattatccgctcagttcactgaatcattttatggagacgaatgcagattcggaagaaatgcaggagctccttgcagattttccgaaagcagcagaagatattttcggggaagtcgggattacacatgcaaaggaccgtttttgctttgctttatcggaaaaagcatcggaatatgtgcatgaaaatatgaaaccgaatgaatttatcaaagagctggtggaacttgtcgcaaagcatggctgcacgatggaagatatcgaagtattgttccgttctcattcagacaagatcgtggcagaacctatggacaatggagaatttgaccggatgatccggtttgaagagggagaagacaagtattattattgctttaaagatgaaggatgccatattatttatcatcgtttcctgccggaagattatgcggattttgatttttaatcgagtaagaatttatatggattttgattcttaagttgaataagaaatttatgcagatttggactttttaagccagataagacaataagaaatcgaggtaacaccaatgaaaatcggaatatatgattcagggatcggcggactttctgtgcttcaccgtgcactgaaaaagatgccggaagcagaatttatatattatgcggatacaaagcatgttccatacggagaaaagacgagggaacagatcaaaggatatgtagaagaggttctgaatttcctgatcgcgaaggaggttgatgcaatcgtaatcgcctgtaatacggcaaccagcgtggcaacgaaagaattcagaggcaaatttgccgtaccgatcgtcggtatggaaccggcagtcaagcgcgcgctcaagctctatcaggatatgcagaaacggatcctggtaacagcaacaccggttacgatagccggagaaaaattacgcagccttctggaaaaagtagataccgaacacgaagtagaccttgcgccacttccaaaactggtccgctttgccgaagccggaagattccaggacccggaagtagatgaatatctgaaaaacagccttcagagctatacactcaaccagtatgctgcagtcgtacttggctgtactcacttcaactacttcaaacagtctttccgcaaaatcttcccgggagaaatccatttcgtagacggcaacgaaggcacccttcgccagctaaaacgagttctccccgaacaaaccagaccaggagaacccagcaaagtcacctactacttctccggagaacctgctgatgatgagggtatgaagaaaatccaggcatgtatgacgcagttagataaagtatatgagatcaagtaaatactgatatcgaattataaaaaataaaacactaaaacaagccaaatagtttatagtaaaatataagaactatttggcttgtttttattcttctctggtggtgtcacaacctattttattgtacttcctgaatcccagaaatatcactatctatcatcatcgaataattggtataatacacgacaaacccaggcttgcttccatttggtttcttaacctgctttttctctacatagtcaacctccaccttttcagccccggaattcttcgagtaatgcgcagcaagtctggctgcctcttcaaaggtccggtccggaagttcttccccgttcgtcttcacgatgacatgggaacccggtgtctttttcgcatggaaccaccagtccccgccatttgcaaaatggaaggtgagttcttcgttctgaagattattttttccaacatacatatggaaaccgtctgaagaaatatagtggaacggtttgcttgtgatcttcacctttttggcagactgctttctgcggataaatccactttcgatcagttcttccttgatctggatcaggtcatcctcgcttcgtgcaatatccagggatttgctgacggactccagataatcaatctcatctttcgtttctttgatcagttctgaaagagcctcgaaagtacgtttctgtttattataccggtcaaaatatttctttgcattttcctgcggtgttttctgcggatccagcggaattttgatcatttcgttagtataataattgagtgcttccagttcttttgcaccttcttccagattgtaaccgtaggtgtgaatcagttccccgtataccttgtatttatcgcggttttccgtatcgcgaagctgctttaactgcaggtcgtatttcttgcggttacgttccagtgctgtctgaaccacacggcgcagatccgaagatttctggcgaatccgggtgatcagatcacgggaagaataataagtccggatcacttcggaaatcgaatcataagattttacctgatagttggaaaagtgggtgagcagaagagatgagaactctttcggctcatttccatcgtaataaatagcgggagagaatttgctttctgtcacctgctccataaaataggtaaactgccggtacagatgcgccagcagatcaccggacatctccgatgccggaacagaagagtcgattcctgccagatagcagatctcttcggcgacaaccggactgattccggtaaaactgttgtagatcgcttttccgaccggcattggtttggagagaagttcctgtgtgaaattttcctccggtatgccaagtggattctcttttttcatagtatccgggataaaatattctcttcccggaagaacctcacgcacagaactcatctgcgcggaaacatgcttgatactgtcgatgatcattcctttttcattacagaaaataatattgctgtgcttgcccatgatctcaacgatcagggatttgcggcacagatctccaagttcatccaggtgctcgatctcgaagcggatgatccgttccagggaaggctgagaaatgcctacgatgcggccatttgcaatatgttttctcagaagcatacagaaattcggcgcagtcatcggacttggtttgttatctctggacagatagatcagcggcagggatgcacttgcggagatgaccagtcttacctgcccttttgcaggtttgatcgtgagaagcagttcatcattttccggctgtgcgatcttggcgatccgtccgttcaggatggtatcatttaattcttttacgatatttgcgattgtaattccatcaaaagccattttaaaaattcacctcatatttatccgggaatatgccagggcacattcttttttcaatgggctcattatagcatagagaggcatgcatagacaagtgaaaatgccctgtcacccggttgacgagtaagtgtaaatgaactataataatcgatagtaaaacggcccttaaaaggtcagtaagaagagggaaaatcaaatgataaaaagtatgacaggctttggacggtgtgagatcgccgaagcagaccgcaaatttaccgtagagatgaagggggttaatcaccgttacctggatgtgaatatccgtatgccaaagaagcttaatttctttgagtccgcgatccgtaacctgctcaagcagtatgtgcagagaggaaagattgatattttcatcgggtatgaagatatgacagaaagccagatgactttgaaatataatcagaagctggcagaagaatatatggcaagctttaagcagatgaaagaacagtttggacttgacaatgatgtgcgggtatccacacttgcacgctgcccggaagtccttacgatggaagaacagtctgtggatgaggaagaactgtggagtggtcttgaaaaagcaatgaaaggcgcatgcgaacagtttgtacagaccaagactacagaaggtgagaacctgaaaaaggatatcattggcaaactggatggaatgctggaagttgttgccagggttgaagagcgatctccgcagatcgttgctgaataccgggagaaactggaaacgaaagtgaaggagcttcttggggacacccagattgacgaaggacggatcgcggctgagattgtgatcttctctgacaagatctgtacagatgaagaagtggtaaggctgaaaagccatatcaagcatatgaaggaaactctggaacagacagagggaatcggacgcaagcttgatttcattgcgcaggagatgaaccgtgaggcgaacacgatcttatccaaggcaaatgatctggaagtatccaattatgcaatcgatctgaagactgagattgaaaaagtccgtgagcagattcaaaatattgaataaagctttgaaaaatgtaaaaagatgtgttaaaataacatttcaatgtctgagtatgcaggagaactgattatgagagaaaaaaaaggaattcttattgtagtatccggattttccggagccggtaagggaacactgatgaaaaagctgatgcaggactatgataattatgcattatcgatctctgcaaccacgcgacagcctcgtgtcggggaagaagatggaagagagtattttttcagaaccaaagaagaatttgaaaaaatgattgcgcgtgatgagcttatagagtatgctagatatgtagaaaattactatggaactccgaagcagtatgttatggagcagttagaggcaggcaaggatgtgatccttgagattgagatccagggtgcgttgaaagtgaaagagaagtatccggataccctgctgatgttcgtgactccgccgagtgcgcaggtactgaaagacagactggtaggacggggaaccgagaccgcagaagtgatcgactcgagaatgaagcgggcagtagaagaatcacagggcgtagagaagtacgattatcttgtgatcaatgatgacctggagcgctgcgcaaaagagatgcacagcattattcagggtgagcatgaccgggtaagccggaatgctgactttatagatgatatcagaaaagaactgaaggaactgtaggaaaggagcagaatttatgttacatccatcatataccgatttgatgaaagtagtaaatcaggacgtggaagaaggcgcaactaagattgtcaacagccgttattctatcgttcttgcaacagcaaagagagcgagacagatcattgacggcgagatgccgcttgttcctgttaaggacggcgaaaagccgctttctattgcaattgatgagctgaacagtggaaagatcaaaattattgcagaagatgcagataaataaaagaagttcgataccctgcagctgtctgcggggtattcttatgataggggattttattttccggtgaagatgatttcccctgccgcccagaaattatgcttgaggagaaatttattttatgaatatattattcatttcattaggctgtgacaagaaccttgtggattcggaggtcatgcttgggattcttgcaaaggacggtcatcagatggtggacgatgagacaatggcagatgtcattatcattaacacctgctgctttatccatgacgcaaaggaagagagtatccagaatattcttgagatggcagatctgaagaagaccggtagattaaaagccctgatcgtaacaggctgtcttgcacagagatacaaagaagagatcattcaggaaatcccagaggttgatgcggttctcggaacgacttcttatgaagagatcgcacacgtgatcgatggagttttaagcgacagtccgatggagcgcggagatgtgcgcctgactatgaaggatgtggattatctcccggtgacagacacgcaccgtatggtgacgaccggcggacatttcgcttatctgaagattgcagaaggttgtgacaagcactgtacttactgtattatcccgaaggtacgaggagatttccggagtgtgccgatggagcatctgctggaggaagcgcagaatctggtagacggaggggtgaaggagctgatcctggtagcacaggagaccaccatgtacggaaccgatctgtacggggagaagcggcttccacagcttttgagagcgctttgcaagatcagcggacttcgctggatccgtattttatactgctatccggaggaaatcacggatgagctgattcaggtgatcaaggaggaaccaaagatctgccattatctggatctcccgatccagcatgcaagcgatggtatcctgaagagaatgggaagacggacttccagagcgcagctcatcgagaccattgagaagcttcgacgtgagattccggatatcgcacttcgcacaactttgatcactggattccctggagagacacaggaacagcatgaagagctgatggattttgtggatcagatggaattcgacagacttggcgtatttacctactcaccggaagaggatactcctgcagcatctatgccggatcagatcccggaagaagtcaaagaggaacgtcaggcagggctcatggaacttcagcaggatatcgtatttgaccaggcagaagaccggattggggaagagctgcttgtgatgatcgaaggcaaggtagcagatgagaatgcctatgtgggaagaacctaccgggatgcgccgaatgtagacggacttatttttgtgaacacatcggaagaactgatgtcgggagattttgcaaaggtaaaagtgaccggagcagcagattatgatttgataggagagttattatgaatttaccaaataagttaacgattttacgagtgattttaattccgttttttgtagtgtttatgttatttgatattaccggagcagcagataagtggatcgcacttgtgatcttctgtgttgccagcctgacggatatgctggatgggaaaatcgccagaaagtacaacctggtaacgaacttcggtaaatttatggatccgcttgcagacaagctgctggtatgtaccgcgctgatctgtctgacatctatgaaccgactgaatgttattgttgttctggtgatcattgccagagaatttatcatcagcggattccgtctggttgcttctgacaatggaatcgtcattgcggcaagctactggggaaaattcaaaaccgtatcacagatggcactgatcattgtgctgatcatggatctgggcggtgtgtggaatgttgtaggaacagtccttacatgggtagcactgctcctgaccgtcgtttcactgatcgattatattgcaaagaacaaacaggtattaacacagggaggcatgtaaaatggttgtagagctgatttctgtcggcactgaaattttacttggcaacattgtgaatacaaacgcagcatacctagcagagaaatgtgctctgctaggttgttctttatatcaccagactgttgtcggtgacaatgaagagcgtatggaagaagcaatccgccaggcaatagagcgcgctgatatcgtaattctgacagggggacttggccctaccaaggatgatctgacaaaagaagtaactgcaaagatatttggcagaaaactttatatggatgaacattccagggctcgaatccgggactattttgagaagattaagagtaaaaaggtgacagagaataactggaagcaggcattggttccggaaggcgcgatcgtgatcgacaatctgaacggaacggcacctggactgatcctggaggataaagagcgcggcaaagcagcgatcctgatccctggtcctccgaatgagatgaagccgatgtttgaacacgacattgcaccgtacctcaataaaaagcagccggagggaatctattcccatatggtaaaagtgtgcgggatcggggaaagcagggcagagaccatggttgcggatctgatggatgcacagaccaatccgacgcttgcgccttatgcaaagacaggagaggtacattttcgtgtgactgcaagagcatgctctgaagaagcggcagaaaaactgatggagccgatgatcgaagagatgaagaagcgttttggtgatgctgtttatacgaccgaagagaatgtgacactggaagagtcggtgatccgtcttctggaagagaagaagatgactgtgacaacggcagaatcctgtacaggcggaaagctttccggcagacttctgaatgtgtcgggagcttccagcgtgtacaatgaaggatatattacttatgcgaatgcatcgaaggaaaagattcttggtgtgaagcatgagacactggaaacctacggggcagtcagtgaacagacagcagcagagatggcacttggggcagcaaaggcggcaggtgcggatgcggcacttagtgtaaccggaatcgcaggacctggcggcggcacagcggaaaaaccggtcggacttgtgtatatcggatgtgcggtaaatggagaggtaacggtaagagagtaccattttaccggcaatcgtgagaagaaccgggactatgcggttgcacgtgcgatcacgctcttgcgggaagaacttttaaagagggcgtaagagagaaaaccagttcattctggaaaagatgaggtacagaaaaatgatcataaaaagactatatagcagtcaggaggttgtggaaggtctgcatctggtatgggatgtatttatcagagaaaacgccaattcctgtacacagcagggaatcgaggaatttgcccgttttatcaagatggagaattttatgcctcttgtcgaaagcggagagatgatcgtctttggcgcggtagaaggacaggatcttggcggtgtcggagccgtgcggagggatggacatatttcccttctgtttgtccgcccggatttgcggagaaaagggattgcgaaggctcttgttggtgaaatgtgcagatactgtacgatgcagtttgctctgatgcgtatgacggtcaatgcatcggttgtgagtacggaagcttatcaccatatgggattccgggatctggcaccggttcaggaaaagaacgggatccgttttgttccgatggatttgatgatatcaccggcaaatgtaagatcttcctataatggaaagaaacatacgggactttttatcgggatcgcagttaccgtacttatttttctgatattcctgggactgcttttcggaaaaatcatcagcaattttgcgagtggtgaaggaaaacaggaggattcgtcacagatttttgaatataacccggatgaggacggagaaattgacgatatctttggcagtaatggaaatgaagaggataataaggaaagcagttctgaagaagcacagggaatcgaggcaattgaaggctacgaggcagaaaatctgccgtatacgatcacggaggaaaattacacttatttttccaatggaaataaaggcgaatatccgatgcagtttgatgtcaaatatccgcagatcacaggtgtggaaggtgaaaatattgacaagatcaatgaaatgctgaaggactgtgcgatgagtacggtcaataccttatatctggctccgagtgattctatgaaagagaaaatgttggaggaatcgaatccgtttttaggaagtcttgtaacgtacaaggtttcttatgcaggagaagattttatcagcgtagcattcaatgatatttattatgcaggaaatacttctgcacagtattgtgacctccgtacccgcaacatccgtatttctgacgcaaagcagtttgaagtggcagatatcgtggatctaagcgatgcatttatgcacgattggatgaaaaagatgaagggtgaagcaccatcggcagaggtgttaagcagtgtgaaattaaatgatttccgacagattttaaatggggaaatcctggagaaccggtactttgatgcattctttgtagataaggatggaattgagatcggaattacttaccattacccgggagatggaaaaaaatcttctgcggagagtggatggatcacagcgccgtttactatgaaagaaataattgaatataaaacagacagtgagttctggaatcttgtacaaagtaacaattgacgaatgtcgaaaattgtgcgaaaataaatacatatggtgttaaaacaatcacaaacgccttataaaagaaaaacagatgtatttgaaaggagttttaacatgatttattcacatgaagtagaaatgatgtgtccggtagctcagggtgcaaaccacggaccagctccaattccggaagaagcaaaatgggtaaaggctaaagaaatcaaagatatttccggtcttacacatggtgtcggctggtgtgctccacagcagggtgcatgcaaacttactttgaacgttaaagatggtattattcaggaagcacttgtggagactatcggatgttcaggaatgactcattccgcagctatggcttcagaaattcttccaggaaagactattttggaagcacttaacacagaccttgtctgtgatgcaattaatacagcaatgagagaacttttcttacagatcgtatacggaagaactcagagtgcattctcagaagaaggacttccgatcggtgcaggacttgaagaccttggtaaaggacttcgttcacaggttggtacaatgtacggaactctcgcaaaaggaccacgttacctggaaatggcagaaggttatgtaacaggaatcgctcttgatgaccatgatgaaatcatcggataccagttcgtaagtcttggaaaattcacagactttgtcaaagcaggcgatactccgaatgaagcttgggaaaaagctaaaggacagtacggacgtgtagctgatgccgttaagatcattgatccgcgtaaaaactaattacatacataagtaattaacgggttatataggcaacaatattttcaggaggacaattaaatggctttatttgaatcatatgagagaagaattgataaaatcaatgaagttttaaacagctatggcattgcttcactcgaagaagctgaaaagatcacaaaggatgccggactggatgtatacaaccagatcaaaggtattcagccaatctgttttgaaaacgcatgctgggcttacatcacaggtgcagcaatcgcaatcaaaaaaggatgtacaagagcagcagacgctgcagcagcaatcggagaaggacttcaggctttctgtattccgggatctgtagcagatcagagaaaagtaggtctgggacatggtaaccttggaaagatgcttcttgaagaaacaacagactgcttctgcttccttgcaggacatgaatcattcgcagctgctgaaggtgcaatcggtatcgctgaaaaagcaaacaaagttcgtcagaaacctcttcgtgttatcctgaacggtcttggaaaagatgctgcaaagatcatttcaagaattaacggattcacatatgttcagacagactatgactattatacaggagaactgaaagaagttcagagaatcgcttactctgacggacttcgttctaaagtaaactgctacggtgcaaatgatgtacgtgaaggtgtagctatcatgtggaaagaaggcgttgacgtttctatcacaggtaactctacaaacccgacacgtttccagcatccggttgcaggtacatacaagaaagaatgcgtagaagcaggaaagaaatacttctcagttgcttcaggtggtggtacaggacgtacacttcacccggacaacatggcagcaggaccggcttcttacggtatgacagatacactcggacgtatgcactctgatgcacagttcgcaggatcttcatctgtaccggctcacgtagaaatgatgggtcttatcggtgcaggtaacaacccgatggtcggaatgacagtcgctgttgctgtaagtatcgaggaagctcacaaagctggtaaattctaagaaaaccgcgtaaaataagggcttgtgaatgcagtagatggtagtaaaaagtaggaaaatgtagttaactcatacattactcatacattagtcctacaccttactcatacactatacgaactaacaatttactgtattttcagtatttcattatgcaaccattgtgggtcacgcttagtatagactttttcagtaatgtcgtatatttcgtgacccaccatttttttaatggcatattcatcaaccccagcattcttgcacatcgttataaaagtatttctaccgtcatgaggtctgtgatctggattcaattctaaagcatcaacaagtgcttctattctacgtctatacttatcatatgttagcattaaattagattttgccgtattcgtatcggtacaattaaataagtattcactgttcaactcttgtgccttattgtaccatttaataacaagaggtctaattctaggatgaataggaactgttcggttagtacctgctttagtcttcatatcaccagttatttcccggttttcaagatctactttttcaagctcaatctaaacattgatttgattcgttcttttgtagatggagacggtgttctactttcacccttcttatctacatatattccattttccattgcatcttttaaatgaagcactcttactgagctatttgtacgatgatttagattatgcacaaagattagttgataaacacagtgaaaagggaaccccgttacttgacaaaaatggaaattggttacggaaagaaaaatttacagatacgaaagctattggtgttcatttagatataaacgggaagaaagtagaaactgatgccggtatgatcgtatattctaaaaccggaactcatgtatatccaagaaaggaaatcaaataagtatgaaaataacaaaggatttagaaggaaaaagagtaaaaattacagatattgataacgaaatatttgagggaattgtatctgactatatttatcctgaagataatgagccagaaggagtagctggaatttgtatcgaagattgtcctcaacgtcctggcgactggatagggtttaatgaacacgatattaaagaaattaaaataacagactaaaaacattacggaagacttggttaatagctgagtcttctatttttatgtatggaggtaaaagcagtgagtgaagaaaaagtaaattattttgaagaggaaatgaaagctcttttagccggttatataagtgatcaggatacgcattaaatcaatacgtatgcaaaattaagccaacagggtattactttcttttgacaccaaatcctgtttctcacatatactaatatcacatctgattgaatcgtttatatataaaatcttccttaaagttctaaaaaagaaaggcaggctatccagataatggagcaacttatggattatgtaaaaccggaactgcttattgtgaccgcagttctatactttttcggaattgcacttaaacaagcagaatttatcaaagataaatatattccgatcacgcttggggcgacaggcattatcatctgcgggatctgggtgacatctaccgcacatttcgcaggagcacaggatgtgttgaccgcagttttcgcatccgtaacgcagggcattgttgttgcaggactgagtacctacatccatcagattatcaagcaggcaggaaaagaagagtaggagtagaagtggtatggcattaaatggaattgacatcagtaactggcaaagtgggatcaatcttgcggttgtcccgtgtgattttgtggtgattaaggcgacagaaggaaccggttatgtaaatccggattacgaaagagcctaccgccaggcgaaaacagcagggaaatgcctgggcatttatcactatgcgtctggtggaaatatacaggcggaggcagaatattttctgaagaatgcagggagccgtgtgggggaggcaatgcttgtgctggactgggaagggcggtccaatccggcatttggtgtgaatgaccgggaatgggtgaaagcctggtgtaattatatttcaacaaagaccagcgtcaatcctgtgatttatgtgcagcaaagtatgatgagccgattgcagaatatcggaaactatggactgtgggtagcgcagtacgcgagtatggagccaatcgggtaccaggaaaatccatggaatgagggtgcatatgcctgtgtgatgcggcagtacagttcttcgggaagattaagcggatggaatggcaatctggatttgaataaattctacggagaccggcaggcgtggagccggtatgctggaaaaggaaaccagacaacttcagagaaaccttctgaagaggaagaaaaccaggaaggaactacgctgcatctggtttttcggacgatgcgtggagaatttggaaatggggaagaacggaaaagctggcttggaaccagatatggagaagtgcaggggatgatcgactatatttccggtgccagtacagagacactggaaaaggaagtgcgtgccgggaaatatggcaacggggaagtgcggaaaacggttctggggaaacggtatgaagaagtacaaagcagagtcaatgccgaagaaaacaagtatcatatcgtcaaatccggggatacgctttcgaaaattgcaacgatatacggaacatcttatcaggaaatcgcaaggttgaacaaactacaaaatccgaatctgatttatgtcggtcagaggctgcggatcaaataaccggctaatagatttgatattcagaatctggtctttgaattcagtaatttggcaaaaagagctattgttttcagctttttggtgtgctatgatgaaaaaaatgaatacacaggaggttttgggatatggataataacttaaatgaccagataactgagaatagtgaaggggaggaaaagagtccatcttcttacaccgatcccaatgcaggatatacagaagcagagccgcaggcaaagaatgacaatagcgtgccaaaagaggcagcggacgataatttaaagcaggaagaaaaaagtcatccggcatatacttacggtgaaatgccaaagtcagaaaacggaagcggttacggacagtcagcaccggacggaagcgcttgccattctggaacttcggatggaacttatgaaaataatacttacaacggaaattcgtattataacggaaccaatcagagcggagcttataccaatgggtactctgacaaccagtatcagaatagcggttataataccggatttaacgcgagcggctataataacaattacaatagccagaacaattgtcagatgccgccaaagcagatggatctatctccactttctaccggagaatggcttttaacgatgattgtcggaattattccatgtgcgggactgattctgtatattatctgggcgtttggtaatagtggcaatctgaaccggcgtaactactgcagagcatccctgattcttcaggtgatttcctatgtgcttgtgattttctttgttatcatcgcagcgatcggcagagtaagctattatggttattaaataagtatctggcaggcttttcggcagggcagcagtgctttgctgaaaagctttttcatttttttagaaattctttagaaatctattccggttctctttagctttaggagatagactatagtcaaggatgagaaaaagaggagaaaagcagttatggaaatgaatcatgtactggtcgttgaagacgacaaggaaatcagagaaggtgtggaaatatacctgaaaagtcagggatacgaagtatttcaggcggcagatgggattgaaggtctggaagtgatcgagaaagaggaaatccatcttgcaatcgtcgatattatgatgccgcggatggatggaatccgtatgacgatgaagcttcgggaaaaatatgattttccggtgatcatgctgtcggcaaaatcagaggaagtggataagatcatgggactgaatatcggggcagatgattatgtgacgaagccatttacaccgatggagcttcttgcaagggtgaattcacagctcagaagataccggatgtttgcagagaagctaagagatcgtgaagaaaatcagaatatccatgtgatcggcggtctggagctgaatgaagctacggtggaggtatcggttgacggagagccggtgcgcctgacaccgattgagtacaaaatcctgcttctccttatgaagagtcctggaagagttttttcggcagaggaaatttacgagcgtgtatggaatgaaaaagcgatcaataccgatacgatcatggtccatatccggaatatccgtgaaaaaattgagagctgcccgaaagaaccaaaatatttaaaggtggtgtggggcgttggatacaaaatcgaaaaacaggcataaactagggattgtcctgattttaggtgtaatcttacttgcgacggtgatcgtgttaggaaactataatactttttataagaatgcaaaaaaggagcaggacagtctgacacagaattaccggacgagtgagtcctttatgaagacatttattcgggactgctatgtattgtattccaaagaatccggaaacgaatataacgtaaagtttctggatgattattatccggaatttgatgagaaatttaaccggcagattgcatatatgaattaccaggtgcaggatgcaaacggagaggtaatcgatggataccggtcgaatagagattcctgggaaaaagtgaaagataccgagcttgcagattatgctcttgggattaagatctcgtttgacaaaaacggtgaaatcaagattgatcaggtgatgggaacggaagtaaccaaacaggaagctgttctgaagatcctgacctcaaatctgccggaaaaaatatttgaatatgaagatgaaagtgagattgaaaatatttcaccaaaagacaggacctattatttcatgatgacggaagcaaagctgaatgcttatgttatgcgggtatatccgattacttcaatggtgggaaacgcggcggtttatacaatcttgacccttatattgttggtcgcacttctggcatggctgattccgatgaagaaagatctgcatacaggagatgaaaaaattttccatgtaccatttgaaattgcgatagcgactggtattactggaattagcctgattttcagctgtcttggagaactgattatgcacgcgaaaggaaatgtgtggccaatcgattttctggtctggtttgttttctttgcagtcatgtactgggtatccggctgtgtacgccagatccggcttcttggagtaaaggaatatgtgaaaaaaagagttctgctgatctggatctggagaagattcggaaacggaatccgaggcggtatccgctggtgcaagaataagattgaagcattttatcattctctggatcagttcaatttcaaggaaaagaacaataagattattttgaaaatcgtgctgttcaatttcgcaatactgctggtgatctgttcattctggtattacggaattgcaggactgatcgtatattctgtaatcctgttcctgatcctgcaaaaatattttaatgatctccggaaaaaatatgcattgcttttggaggcaaccaataaaattgcagacggaaatctggatgtagagattgaaggtgatcttggtgtgttcagtccgttccgtaatgaaatccagaagatccagaccggatttaagaaagcggtaaaggaagaagtaaaaagccagcgtatgaaaacagaactgatcacaaacgtatcacatgatctgaaaacaccgctgactgcgatcataacctatgtgaatctgttgaaagacgagaaagatgagaaaaagcgaaaggattatattgatattctggaacgcaaatctatgcgtctgaaagtcctgatcgaagacctttttgagatcagcaaagcaagcagccagaatgtaaacctgaatttgatgaacgtggatatcgtcaatctgtttaaacaggtaaaatttgagctggaagataagttcgaagaaaaaggtctggagttcaggaccactttcccggaagaaaaagtgattctttgtctggacagtcagaagacctgccggatctttgagaatcttctgaataacattgtaaaatatgcacttccgggaacaagagtttatgtggaaatcgaaaagacggagaaagatgtatttatccgcctgaaaaatatttccgcaaccgagctcaccttcaatccggaagaaattacagaacgcttcgtccgcggagatgagtcccgcaataccgaaggctccggtcttggccttgcaatcgtaaaaagcttcgtaggtctccagggtggaagcttccatatcgaaaccgaagcagacctcttcaaagccgaaatccgctgggctttgccgggagaagagacagtgaagcaggaagcataagaaaaataaatggtaccggattcaattttttttacaactgaatctggtaccatttatttttctgatttgtctcataacctacatcattcaacttttttactttggaaatccgctggagtaatgaatctcataatcatccgtgataaagagtgcctctgcccccttgattccttcgatatatttcaatccatcatctaaccccatcacaaagcaggttgtactaagtgcgtccgcttccgtagaagagtcacagacaatactcaccccaagcagattatttttataaggatacccggttttcggatctaagatatggtgataaatcttgtcgcccaccttaaaataccgctcataaatcccggaagaaactacagattgatccttgatctttacactggtgatcgcttctccattctgtgcaaacggcttctggatcccgatattataatccgagccatccggtttgccgtcaagagccagcacatttccgcccagattgatcagcgcatgggatacattctgctctttcagatatgctttcagctgatccgcaatatatccctttgcaattccgccaagatcaatagccgcctccggatccagaagctgaaccgtatttccatcaaccctcacattctcatatccgatatgacgtttcgcttcctgaatcgccgcatcatccggaacggtccccgtattattcttaaaatcccacaagtcactaagtggagcgatcgtaatatcaaactttccatctgccagacggctgtattccacgcctttctgaatcaaatccaccgtatcacccgaaagtgtcacaggcttcccgtttgcatggttcagctcataaatctcgcttccttccgaagtccggctaaaccgcgcattataatcctcgcatttcgccacacaagcatccagaacatcctctgaatccttatcataaaccgtaatcgtcaccaccgtatcaaacaccgtcaccgtccgcgacaccggctgcggcgaactcccagaacatccgcccagacaaaaagtcccaaacaaactcaaacaaataccaattcccaaactttttattttcatcgcaaacctcctcaaaccataacctacagcattgtttttttcataaacttcctaaaaacgacataatgaaaatttacgaatctcaggtctgtgcaaccagctaatgcacagccgtaagggaagcgaaagtcctgcacgcctctattttgtgcaatggagatgaaacacaaaaatcgtggaagccattgctgaacacgattttcgccctaagtggttcatcggaatggtttgcacaacttgaggtgtgcaggactttcgcttcccttccggcgtccccattttcttcttccacaaaccgtcccattcgtcaattaccccattatacgttcccctatgaaaaaaatcaatcgaacacttgattgcattagataaaatgatgtgttagaataaacaaagaaaaaggagaaccctatgagccataaagaaaataagagccatgaggagaaagcatccggtttcaaaaagaatgatctgattcttgtcctccttgtatttgttgcggcaggcattttttttgcaggacatctattcacgagccagaaaagcgcaggcgttgtagaaatacagattgacgggaaagtggtagagacactggatctgcagaaagagcgtgcatttaagatcaacggaggaacgaacaccgtgcagatcgagaacggaaaagtgaaaatggcagcggccaactgtccggatcagatctgtgtacaccagaaagcaatttcaaggaacggagagagtattatctgccttccgaataagatcgttctgaaaattgtcgatggagaagaagccgaactggatgcggtgacgaattaagatatgaagaaaaatacagtcagaatagcgtggtttggtgtatttactgcccttgcgctgatatttagttatgtagagactctgatcccgtttcagatcgggattccgggggttaagcttggactggcgaatctgatcgttgtggtggcactgtacaagatgggtggaaaggatgccatgttgctttcggtgacgcgtatcgtgctgtccggatttatttttgccagtctgtttagtattttatacagtctggcaggcggacttttaagccttgcagtgatggtgattttgaaaaagcggggatcattcagtgtttttggagtcagcatggcaggtggtgtctttcataatgtcggtcagctgatcgtagcgatgctggtcgtggagacattcagcgtcgcctattatgtgccggtgcttctgatcgcaggagtgatcaccggatttattatcggagttgtggcaaatgaaatgctcaaaagacttggcagcatcgtattgtcatagcatgggaggaagagatgatttcatatataagaggggagcttgtagctctcgaagaagataaagtgatcgtagatgtaggcggcgtgggctacgggatttttatgtccggacaggcgatgggacagcttccgccggttgggagtaaagtgaagatccacacctatctgaatgtcaaagaagatgtcatgcagctgtatggatttttaaaccgtgatgcgctttctgtgttcaagcttctgatcggtgtcagtgggatcggaccgaaaggaggtcttggaattctggcgcagcttacaccagacgaacttcgatttgccgtgatgtcgaaggacatcaaggcaatttcagcagcaccgggaattggcaagaagacggcggagaagctgatcgtggaactgaaggataagctgaagattgaggacgtactggagcaccaggtggaagcggcaaatggagccgctgaagatacggtaaatgcacaaggacttcaggcagatgcggtacaggcacttacggcgcttggctatggaagtactgaggcactgcaggcagtacgaaaagtggaaatggatgagagcacgacggtggaagatctgctgaagggtgcactcaaatatttgatataagaggattaggatgggaagaagaattattaccacagagaatctggaagaggatgtaaaaattgagagccatttaagacctcagcttctggaagattatattggacaggcgaaggcaaaagagactcttaagatttatatagaagcggcaaaaagcaggggagaggcactggatcatgtgctgttttacggtccgccgggacttggaaagacaaccctcgccgggatcattgcgaatgaaatgggcgtaaatatcaagatcacgtcaggtcctgcgatcgagaaacctggggaaatggcggcaatccttaataatcttcaggaaggagatgtgctttttgtagatgagatccaccggctgaaccggcaggtggaggaagtactttatccggcgatggaagattttgcaatcgatattatgatcggaaaaggggcttcggcaaggtcgatccgtctggatctgccgcattttacactggtaggggcaaccacccgtgccggaatgctgacagctccgctccgggatcgtttcggggttgtgaaccgtctggaattttatacggaaaaagaactgcagaccatcatcatccgttcagcaggcgtgctggatgtggagatcgatgaaaagggagcccttgagatggcaagacgttccagaggtacgccaaggcttgctaaccggcttttgaaaagagtccgggattttgcccaggtcaaatacgagggggtgatcaccgaagaggtggcaaggcaggcactggatcttctggatgtggaccggcttggacttgatcatgtagaccgtaatcttttgacgaccatgattgaaaaatttcagggaggtccggtaggactggatacccttgcggcagcgatcggggaagatgcaggaaccgtagaagatgtctatgagccatatcttctgaagaatggctttttacagagaacaccaagaggaagggtggtcacagatcttgcgtatacccatcttggatttgacaagaatgaagaatagaaaggaaagagacgatgctgaagataaaacaatatgtgaaagcagagagtctggagcaggcgtatgaactgaaccagaaaaagacgaaccggatcgtcggtggaatgctctggctgaaaatgagtactgcgcagatccagactgcgatcgatctgtccggactcggactggatcagattgaagagacggaggatgcatggaagattggatgtatggtatcccttcgtgatctggagttacacgaaggattaaatgaattgagctgcaacatgatcagagaaagtgtgagaagtattgtcggtgtacagttccggaatcttgcgacgagcggcggaagtattttcggacggtttggattttcggatgtactgacctgtttccttgcactggatacagaagtagaactttataaaggtgggatcatttctctggaagagtttgcaaagatggagagagataatgatatccttgtccgtgtgatcgtaaagaaaacaccgggaaagggaagctatcagtcacaccgtaataccaagacggattttccggtattggcggttgctgctgaccgttatggagatgaactaaaggtggcagttggggcaagaccgatgaaagcagtctgtattcacgttccggcagaacagctggatgcgtgcacagatctgaaaaaatttgcaaaagagcttgcagcccaggtgccgatgggaagcaatatgcgtggaagtgcagcgtatcgtacccatcttgcagaggttctgatccgcagagcgttagagagaatcacaaacggaggtgaaaagaatgcagattagtctgacactgaatggaaaaaagattacagaagagatcgcagctgatctgcttctgatcgatttcgtgagaaatcatggatgttacagcgtaaagcgcggctgtgagacttccaactgtggactttgtaccgtatttttagatgagaagccggtactttcctgttccgtgcttgctgcaagagcagacgggcacaaggtagatacgctggaaggactgcaggaggaagcagaagaatttggctcttttatcgcaggacagggggcagagcagtgcggattctgtaatccgggtatgatcatgaatgcaatcgcacttttccgcgagaatccggatccaagtgatgacgagatccgggaataccttgcggggaatctctgccgctgttcaggctacgagggacagctcagaggaatccatgattttctggagtacaaaagaaaaggaggagccagatgaaagcagtaggagtaccatttgtaaaaaaagatgcgaaagcactggtgactggaaagccggtatatacaaatgatctggcaccaaaggattgtctgatcgttaagcttctaagaagtccgcatgccaatgcgatgatccaggagatcaagacagatgtggcaatgcgtgtgccgggaatcgaagcaatttatacctggaaggatgtaccgcagcagcgttttacaattgcaggacagacctggccggagcctagtccgtatgaccggttgatcctggaccagcatgttcgctttgtaggagatccggtagcgattattgccggagaaaatgaagcctgcgtagaacgtgcaatgaagatgatcaaggtcaaatacgaggtccttccggcagtattagatcctgaggaagcgctggatggtccaattctggtgcatccggaggacagctggaaggcattgtgcccggtaggagcagataacaagcggaatctttgtgcacaggcagaagatggacatggggatgtagagaaagttcttgcagaatgcgatgttgttgtagaacatacatatcatgtcaaagcggcacagcaggcaatgatggaaccatttcagacggtctgctttatggatatgtatggaagactgaatgtgatgagttctacgcagatcgtttaccatgtgcgccgtattgtttccaatgcacttggcataccaaaatccaagatccgtgcgtttaaaccgaggatcggtggtggatttggggcaaaacagacggcggtaagtgaggtttatccggcgtttgtaacctggaaaaccggaaagccatcgaaaattgtatttacaagagaggaatcccagattgcatcctcaccgcgtcatgatatggcggtgacggttcgcatgggagcagataaagagggaaatatccgggcaattgatctgtatacactttctaacacaggagcatacggggaacatggaccgacaacggtcggactttccggacataaggcgattccgctttatggttcattagatgcataccggttccgttacgatgtggtctataccaaccggatggcagcaggagcttatcgtggatatggagcgacgcagggaatctttgcggttgagacatctgttaacgaactggcagaaaaacttggcatggatccgatggggatccgtatgaagaatatggtcaaagaaggacagttcatgccggcatattatggggagacagcgaatagctgtgcacttgataaatgtcttgcgagagtaaaagaaatgtccggatgggatgaaaagtatccaagaaaagttatgccggatggcaaaatccgcagcgtcggagtagcacttgccatgcagggatcctgcatttccaatgtagatgtcggatctgcaacgatcaaactgggcgaggatggtgtctacaatatgtcaatcgcggcagcggacatgggaaccgggtgtgatacgattcttgcacagatggcagcagaatgtctggactgtgatctggatgatattgcagtatccggagcagataccgatacttcgccgtatgattcaggctcttatgcatcaagtacgacttatgtgaccggtatggcggtgacaagagccggtgaggaactgaaaaagcggatcgtcagacaggcagcgaagatgctgaaatgtgaagtggatgaggttgatttcgatggacacattgcaagaagcgataagaccggagaagaggtgacacttgcggcaatcggagcaggggcaatgtgcggaagtgatattgcgcttcaggtaacagaaagccacagttcgccggtatctccgccgccttatatggcaggcgctgttgaaatcgaattggatccggagacaggacatgtcgagatcctggattactatgcagtggttgactgcggaactgttattaacccgaatcttgcgagggtacaggcggaaggcggaatcgtgcaaggaatcggcatgactctttatgagaatattcagtacacggaaaaaggacagcttctgaacaattcatttatgcagtacaagattccgacccgaatggatatgggaaatctgcatgtggaatttgagagcagctatgagccgaccggaccgtttggtgcaaaatcgattggcgaaatcgtcatcaatacaccggctccggcattgacgcatgcaatcgcaaatgcaacaggtctgtggttccgtgaacttccgattacaagtgaacagattgcaatgggaattatggaaaatgaaaattaaactgatttatctggcggctggaaacagccgccgttttaacagccagaggatgcaaaatacagaaccgccacaatcagaagcagagaacaaactgctttatctgttggatgaaaagccgatgttccgctatttattcgaccgtctggtaaaagtctgtcaaaggcatccggaatgggaaatgattgtggtaacacagtatccggagattgagcatcaggtaaaagcacttcaggaaaacgagcagaaaggtgaacgtttcccggtaaaaacagtgatttcaaaagacagctataaaggagcagcctattcggtaaaagcagggatccgtgcggcaggagatgctgatgcctatgcattttttgtggcggatcagccttattttacagaagaaagcgtggaaggattcctggaaaagatggagcgggaggcaaaagttgtaccgggatgtgtgacctggaatggacaggaaggcaatccagtctggtttccggcaaagtacgggaaagaacttctggaactggaaggagatgccggaggaagaaaggtgttccgcagataccgggaaaaagcagtattttacgaggtgagcctggaaaaagagctggaagatattgattatatgccggaaatagaaaaaatgcggataacagaaggaggcacagagaaaactttccatgtatatgtcatcgaaaatggaaagcttcaaaggaaagagtctctgcttatggcacttggacttacggagcagatggtaccgagaattgctgccgtgggtgcgggaggtaagacttctcttttgaaacagctgcttgctgaataccaagagaagggtgccctcccggttctggtgactacaacccatatgaaaaaagagactgccccttattttgtaatggaggattctatcggaaaaattttggaagtgcataaaagagaaggcatggtgatcgccggtctggatgcaggaggaggcaggatcaaaagcctttctgtaccggtaatggaaaagatctgggagcttcctgcgccggttcttgtggaagcggatggtgctcggatgcttccggcgaaagtgccgggggagaaagaaccggttattccaaagcagatccagatagtcctttctgtatatggactcgatgccatcggacaaaggataaaagactgctgtttccgccctgagcttgtggcacaggtacttggaaaagcagtggaagaggttctgacggaggaggatctggcagagctggctgtttcggcaaaaggcgggaaaaagaatgtcctgccggaaatggatttctatattgtgctaaacaaagcagatgacgaaaaacgtctgaaaatggcagagagaatcgccttaagagtagaacgggattctggtgaaaaagtacggattacatcgtttcgttaatattttggaaaaataaagcaattgtgtgttgaaaaatggaacattgccgaattgtcattgaaaaccattcgtgctatcatagatacgatagttttgacaacgaaagttgtaagtgggtagagaaggaggcaaaaaagtgagtacgaagaatagtaatacttcacaggaactatttaaccttaacggaaaaccatcctttggtcaggcacttccgctggcattccagcatgtagtggcgatgatcattggctgtgttgcaccggcgatcattcttgccggtgtgtccggactttcagaatcagacacggttgtcctgattcaggcatctcttgcaatgtcagcgatttcgacattcatccagctttttccgtttatcaaatttaagtcttatcagataggagccgggcttccggttattatgggaatcagctttgcgtatgtgccgatcatgcagtcaattgcacaggatgcagatgttggaacaatacttggtgcacagatcgtgggcggtattgttgcgattattgtaggaatatttatcaagcagatccgtcatcttttcccgccgctggttacgggaacggttgtatttgcaatcggactttcgctgtatccgaccgcagtcaattatatggcaggtggagcaggaagtgcggattatggttcatggcagaactggcttgttgcgatcatcacactggtagtcgtaacaggactgaatcattttggaaagggctttttaaagctttcttccgttctgatcggaatcatagttggatatgtagttgcgcttggctttggaatggtggatttttcttccgtattaacggcaaaatgggtacagttcccacagccgatgcatttcggaattaaattcgagccatcctcatgtgttgcgattgcggtattgttcgcaatcagctctattcaggcaatcggagacttttcagcaacgacgaccggaggaatggaccgtatgccgacggatgaggaattaagcggtggtatcattggttatggagtcagcaatattgtctgcgcatttttcagcggactcccgacagcaacctacagtcagaatgtcggaatcgtaagttctacgaaagtagtagcaaagagagtatttggaattgcagcgatgatcatgctggttgcaggaatcatgccaaagatcgcatacattcttctaactattccgtcatgtgtgcttggaggcgcaacaatctctgtatttgcaatgatttccatgacgggtatcaaactgatcaataattcaaagatgaattatagaaatacatccatcgtaggacttgccattgcacttggaatgggtgtgacacaggcaaatgcagcacttgcgcagctccctgcatgggtaacaaccattttcggtaaatcaccggttgcactgtctactctggttgcagtgttcctgaatctggttttaccaaaggagaaagaagagtaaatgaagatcctgataagaggagccggggatcttgccacaggaattgcggcagagctgtgggaaagaggacatcagatcctgatgacggatgttgccatcccactcaccgtcagacgtgaggtggcattttcaagagcggtgtacgaagaacatgcagtggtagaaggaatagaagcagttcttgccgacaattttgaagaagcagaaacaattatggcaacacggaaaattgctgtcatggtggatgaaaaagcagaagtgcggaaagaatatctgccggatgtactggttgacgggatcatggcaaaaaagaatcttgggacccggatcagtgacgctcctcttgttatcggtatcggaccgggctttacggcagccggagactgccattttgtgattgaaacgcaaagaggtgagcatctgggcgaagtgatccgcgagggaagtgcaatccccaacaccggaattccgggaaatattggcggctatacggtggaacgccttttaaaggcatccgcagacggaatcatgcatccggtcgcgagaattggtgatgtggtgaaaaaagggcagattgttgcaaggtgcggagatgaacctgtctatgcgaggctccacgggattgtccgtgggatgctccaggaaggtgtaccggtcaaaaaaggattgaagatcggagatgtggatgcaaggatagaggaaaaactttgttatacgatttcggataaagcacgaaagatcggaaacggagttgcggaagcaatcgatcttgtctataaaacaaaataaaaagttgtctggacaacttatttatccatcctttttatggtaaaatataaaaaggtttgggcagaatacctgccgcagtgacggcaggtatttttatgccataatccatataaagtgaggaacaaaaaatgaaactggtaagaacagaagatgcagtggggcaggtgctgtgtcatgacattacacagatcattccgggagttgtaaaggatgctgttttccggaagggacatattgtcaccgaagaagacattccggtacttttatctgtgggaaaagagaatctttatatctgggaaaaacaggaaggtatgcttcatgaaaatgaggcggctgagatcttgcgtcagatctgtcagggtgagcatatgcatccttccggggtgaaggaaggaaaaatcgaactgatcgccgactgtgaaggggtattgaagatcaataccgaaaagctgaatgcggtgaacagtcttggtgagatgatgatcgcatccagacatggaaattttccggtgaaaaccggagataagattgcaggaacaaggatcattccgcttgtgatcgaagaagaaaagatgcagaaggcctgtgaagtggcaggaaaagaaccgattttccggattcttccgtaccagaagaaaaaagcgggaatcgtaacgacgggaagcgaagtgtattatcaccggatcgaggataaatttactccggttgtgatcgaaaaactgaaagaatgtggcgttacagaggtgaagcagatccagtgcaacgatgatcatgagatgatcacagaagcaatccagactctgatcgaggatggttctgacctgatcgtctgtaccggtggaatgagtgtagatccggatgacaggactcctcttgcaatcaaaaatgcctgtacggaagtggtgacttatggggcaccggttcttccgggagctatgtttatgcttgcttattgtgaaaaagaaggcagacagattccggtcatgggtcttccgggatgcgtgatgtatgcaaaacggacgatttttgatctggttcttccgaggattatgtgtgatgaaaagctgcatgaaaaagatttccggcttcttggacagggaggactttgtctgtcctgtccggtgtgtacttttccaaactgtggatttggaaaaggaggatattaaaatcatgagaaagaataacttatttaagaaaacagtggcagcaggtctggttctgctgatgacagcatcacttgctgcatgtgacggtaaaaagaccgacacaaaaacagaagacaaaaagacagaaacaaaggctgacaaagaagaggatgtagagcttcaggtatttatcgcagccagcctgaatacggcaatgacagatattgcagagcgttatgaaaaagagcatccgaatgtgaagattgtctacaatgcagacagctcaggaactctgctgacacagatcgaagaaggatatgagtgtgacctgttcttctctgcagcacagaaacagatggatcagcttgagactgacggactggtagtagaaggaacccgccataatgtagtgaacaatcaggtagtcgttatcacattaaagaacagtgatacagcagtaaccgggcttgaaaacttaaatgaggcaaagagcattgcacttgcaggcggaagtgtaccagttggaaaatacacccgtcaggcgttgatgaatctcggaattctggacaaagtagacgatgcgtctaccatcacaacagaacaggtttctgaagctcttggtggagcagaaatcagtgagcaggcaaatgtaagcaaggtgctgatcgccgttacagagggtgcatgcgaagttggaacaacttattattctgatacatacggatatgaggatcagatcaagatccttcagacagtaagctatgatctgacaggtaacgtgatttatccgatctgccgtgtggaaaataaagaggcagatgatgcaaagaaaaaagcagccgatgatttccttgcatatgtaacatccgatgacgcaaagaagatctttgacagctactatttcgatacaaacgtagagtaaaagaggaacaatatggaagaaataagacagattcttgcaggacttgactggagtccgcttttcatttcaatcaaaacaggaatcgcagcaacgatcgtgtcattcttcctgggaatatgggcagcaagaaaggtgctgaaagcgaagacgggtctcagggctgtgctggatgggattctgacactgccgctggtgcttccgccgacggttgcaggatttttcctgctgctcattttcagtacgagaagaaccgttggatcgtatctttatacgacatttgatatcaagatcgtacagtcctgggcaggatgcgtaatcgcggcaactgtgatagcatttccactgatgtaccggaatgcaagagcagcatttgaacaggtggatgtgaacctgatttatgcggcgcagacgctcggtatgccggagtggaagattttctggagggtgatcatgccggcggcaggtccaggagttgcatccggtacaattcttgcatttgcaagagcgcttggagaatacggtgcgacctccatgcttgcgggcaatattccaggaaagacggcaaccatttcccagaggattgcaatggtcatccaggacggtgattatcagacggcaggcgtgtgggtcggaattgtaatcctgatcgcattcggaatagtagtacttatgaatctggcatttggaaagggaatgaaacatacaaagcaatggtagaactagagataaaaaaaaagtatgaaaaattcaggctggatgttgcctttaaaagtgaaaaaaagcggatcggaatcctgggcgcttccggatgtgggaaaagcctgaccttgaaaagtattgccgggatcgaaagaccggaaaaagggcggatcgtgattgacggagttaccctttttgatgccggaaaaaagatttttctgaagccacaaaaaaggaaagtcggttatctttttcagaattatgcgttgtttccgaacatgaccgtggagcagaatatcgggattggatttaccggaaacaaagaagataagcagaaaatggtagaacagctgatccatcatttccagctggacggactggaaaagctttatccgtcaaagctttccggcggacagcagcagagaacggcactggcacggattatggcatatgagccggatgtgatccttctggatgaaccattttcggcactggatgcgtatcttcgggagcggatgctgaccgagctgatggaaatgctgagtgattatgaaggtacggtgatcatggtgtcccacagcagggatgaaatctacagtttcagtgaagaggttctggtaattgaagatggacatggaatccgcctgggtccggtaaaagaagtatttaatgcaccgcgctataagacagcggcaagacttaccggatgtaaaaatattgcagatgtttaccggatggatgcgcagacggtgtatgtgaaagactgggatgtgcagctgatttttaaaggacgcagtgtgccggagaatgtgaaggcaatcgggatccgagctcatgatctgattccggtgtatggaacgatatccggggctatgctgaaagttaaagaatggaaaagtgtggattatccatttgaacgaaaatattttatccaatgcgagtcgggatgtgaggacttctgctggtttgtccaaagagagatttctgccactctggaagaaaaaggaatgccggatgcactcgcatttccggaagaaaaagtgctgttccttgaaggatagcgtggcagatgctataatggacaaatagagaaaacgggcagaaggtggcagcataaatgcagaaagaacaagacagggaagcgatttaccggagcattttcttctgtgatatggatcggaagaaggcggatgagatcattaaccggttaggcggcagaaccgtaacctatgacaagggcgaaatcattataagagaaagagaaaaactgaacaatatcggaatcctgcttgacggggtactctgtaaagtgcagtattaccgggatggaaccgaacagctggtccagaagcttgtcagctcgtttgttgtgggagtggagattgcggtcagtgaaaaaaagacgagtccttatgatgtttatgcatcggaacaggcacacattttctggtttcctgtacgggcgatggaagaagagggcgttctggatctgcgtgagaggattgagttttacaagaaaacggttcatttccttgcaaatgaagatatccgcaagtgcaggaagattgaattgctgtcgatcagaggaatccgggaaagaatcgagcagtatctgagaattcagcaaagccgccataaaagcaatgcctttgatattgaatttaacagagaacagatggcaaattatctggggatcaaccggagtgtgctgtcacatgagttgaaaaaaatggaaaaagaggggattttgaaggtcagaaagaatcattttgagctggctgataaagaataaaacagaatttctgctgaaaatatcgaaaagtggttggtttttatcagaatatagtttataatgaaaaaaggattaggcggcaaggaggttctttatggcatcgtcaaaaaattatacagaagttttgataggcggcaaagtattcaccctgagcggatttgaaagcgaagattatctgcagaaggtatccacttatctgaaccataaaatcgaggaatgtacaagcagcgatggatatcgtaagcagagtgcggaagccagaagtgtgcttcttgctttaaatatagcagatgattattttaaagccaagaaacagggcggcgcattagaaagcgacatcgaggcaaaagacaaagagatgtacgatttaaagcatgaactgatctcagtacagatcaagtatgagaatgctgaaaaagcactggataaactcaaggcagagaaccaggaacttcagatgaagatcgtacagcttgaaacagaaatgaaaaatcaccgtacaaaatagactgtcctgaggcagtctatttttgatactccggtatacaaagagaaatgtctgcaacacaggggctttgtatacaggttatttaaagatagaggagttatatgaaagacagagttgaaatccttgcaccggcagggagtatggaatgcctgaaagcggcaattgcagcaggagctgatgcggtatatacagggggagcccttttcggggcacgtgcttatgcacataacctgacggaggaagaacttttagaggcaattgattatgtgcatttgcatggaagaagactgtatctgaccgtgaatacactgatcaaagaccgtgagatggaaaaacagatgtatgattatctgctcccttattaccggcaggggctggatgcggtgatcgtgcaggatattggactcttccgttttatccggaagcattttccagatcttccgattcacgcaagtacccagatgacgcttacgggagtggatggggcgaagtttctggaaaaggaaggtgcacagcggattgttacgtccagagaactgagtatggcagaggtgaagaagattgccgatgagacagagctcgagattgaaagctttgtacatggtgcactctgctattgctattccggtcagtgcctgttcagcagttttatcggcggcagaagtggcaaccgtggacagtgcgcacagccgtgcagactgctttaccggacaccggaagcaaagagaccgcagtatctgctgagtcttaaggatatctgtacattggaactgatcccggagatgatcgagagcgggatttattctttcaagattgaaggtcggatgaagaagccggagtatgcggcagcagtcgctttccagtaccggaaatatgccgatctttatctgaaatattacgaagaatgtccggcagaagaggatccggcagcgtatgcgatgaagaaataccgtgtccgcgaggaggatcggcagatgctgctggatctctataaccgtggcggtttccatacgggttattatcatacacagaatggacgggagatgatttccttaaaccgtccgaaccatgcaggagtgccggcagtaaaggtacttgctaaaaaaggcagaaatgtgactgcaaaagcactgacagacctgtatccgcaggatattattgaactcccgatgcgcaaaggcagggaaaaagcagataattatacctgtaaggatgcagtcagaaaaggaatgaatgtgcagatcccggtatttgcagataccccgttcaagagggatgaaatctggacgcgtacaagaaacagcacattgattgacacgctgcgtgaagaatttgtaaatggaaaaataaaagaacggatctgcggaactttccggctgtatccgcaggaaaaggcaacgcttacggtgaagtgccgggatgccgagattacggttgccggtgaaaaagcacaggaagcactgagccagccgatgagcagagagcggattgaaaagcagctgcgcaagacgggaaatacggaatttgaattttcctttttaaagaccgagatcggagaaaaagtatttcttccgatgcagagcctgaacgaacttcgaagggaagcactggagacactggaaaaagtgatctgtgagaaatacagaagaagtggtgaagtgaaagatccggaagaagataagacagagctttcaatggaagaagaggtactttccggatggacggcatcggtaagaaccgcagaacagatggaagtgattctggaagaagaagcaatcggaagaatctatgtggattgtaccatgttccctcgcatctgggagaaggacagctatgtggagtggattacaaaagtacatgcagcagggaaagaaatttatctggttatgccgtatattttccgggaaagaacccgaaaacagtatgaagctgcatataaccggatattcggagccggatgggacggcattctgatcgccaattatgaaagttttgcgtttctgaaagagcatggttataccggaaggattatgaccgattacaatctgtatgaatttaatcaggaaagcaggaaattctggaaggaaaagggagtttttgaatttacagcgcccgtggaactgacagaaagagaactccaggatctcagggtaaaggatggagaagtgatcgtatatggttatcttccgatgatgatatctgcaggatgtattcagaaaacgaccagaggatgtctgaaaaaatccggacagacgacaataactgacagatatcgtaatccatttgtggtaaaaaatgaatgtgattactgttataatatcctttacaattatgtaccattatatctgggagaccggatggaagaggtatatcagatcggtcctgggcggatccgactgatgtttactactgaaaggcagcaggaggtaaggcagattttaagtgcgtattttgaaggaaaagagcttccggagggaacgtacaccaggggacactggaaaagaggaataaagtaggtggaattttgatcaatataattgtagagctgtcaaaatatctgatgatagccctgatgctggtctatacatttgaatgttttgcagtatttaattacacagatgagtatacacagagaagtattttcagaaagcagaatgtgctgatgtttctgcttcatatgattgcatttctggtgatgtatctgcagacaaatgaaacaaaaatgatcggattttacgggatgcaggtggtactgtttctggcggtcattttgctgtatacaataatttacccgcgggtgtcgcggctggttgtaaataatatgtgtatgctgatggcaatcggctttattatgatcaccagactttcgtattcgcttgcagtaaagcagtttctcattgtcagtgcatctgtagcgataagtcttgtgatcccggtcatcatccggaaggtaaaagctctgtcagaatggaaaatattctatgcaattgcaggtgttgtaatgcttggggtcgttatcattgtaggacgtgtgactggaggagcgatgctgaatgttgcaatcggaggttttacccttcagccatctgagcttgtgaagatcatttttgtatttttcgttgcggcgagtctgaagactgatacttcatttaagaatattgtgatcacaacggcagtggcagcaatgcatgtgctgatcttggttctatcaaaagaccttggtgcggcgctgatcatttttgctgtatatctggtgatgctttatgtggcaagcagacagccactttatgtacttgtcgggctgattgcaggaagtggggcatcagttgtggcatataaattatttaaccacgtccgtgtgcgtgtactggtatggaagaatccatttaccgtttacaatgaaggtggttatcaggtggcacaatccttgatggcgatcggcacaggaagctggtttggaatgggactttttcaaggggcggcagatcagatacctgttgcagagtcagatttcattttttcggcaattgcggaggaaatgggattgatttttgcacttggtctgatactggtatgtgtcagtgtttatatgatgtttctgaatattgcgatgcagcttcgggacagcttttataaactggtggcactgggacttggaacctgttatatttttcagacatttctgacgatcggaggtgtgacaaagttcattccgtctaccggagtgacacttccactggtaagctacggtggaacctctgtcctcagtacgatcattatgtttgcgatcattcagggactgtatgtattaagagaagacgaggaagaagacattgaaagaaaaaaattacagagaagacgaacttccagatctggatcagcagctggagagcctgccagacgagagcgggtatcacgaccaaaagaagaaggcagaaggaaaaagccgcagcagacgaacggatggcgaaccgaagaaaaaggccgaacgcagcagcctaaaaaacggacagcggcgtccgaaagaagcacaggcagaaagaagcggagccagtaagaaaaaagagaagcagatgaccaataaagaactgacgagagttacttatatttttgtaacactgtttttggtactgatgggatatctggtttattttaatgtggtaaaaagtaaagaggttgtcaacagcacgtacaatatccgtcaggatcttcttgcggaccgtgtgctgcgtggcagtattacagataaaaatggagaagtgcttgcacagactgtgacaaatgacgatggatcggaaacacgggaatatccggaaggagaagtgtttgcacatgttgtcggatatgccgcaaaaggaaaatccggactggaatcctcacagaatttcaatcttctgacttcaaatgcctttttcctggaaaagctggcgaatgaatttaaagaccagaagaatacgggagatacggtggtcacaaccttggatgcgaacctgcagaatgcagcatataatgcactgggagataacaaaggtgcagttgtcgtgatggagccaagtacagggaagattctggcaatggtatcgaagccgtcttttgatccgaataatgtttcggaaaactgggatgcactgaacaatgacgagaacagttcgcttcttaacagggctacacttggacagtatacaccggggtcgacattcaagctggtgacaacacttgcttttatgcggcagaatccggattataataattattcgtttgaatgtaatggagaattttcacagaatggggcgacgatccactgttataacagcactgcccatggggaagagaatctgacggattcggttgcaaattcctgcaattcttcgttttcaaatatcgggctgcagctggataaggcagaatggagaaagactgccaaacagatgctgtttaacggcaagcttccgggtgatgtgaaatataatgaaagcagtttccgcctgaaaacagatgcaggagatgcagatacgatgatgactgcaattggtcagggagagacacaggtcagtccgtaccatatggcgatgatcgtttcgacgatcgcaaatggtggaaagctgatgaagccgtatctggtggacaagattacaaattatgcaggcacaacggtgaagaaatatatgccggaaagctacaaagagctgatgacatcatctgaagctgcacagcttacggaatacatgaaggcggttgtggattatggtaccggagctgcgctttcaggtgcgtcttatacagtggcaggaaaaaccggaactgctgaggtcagtgaagatggaaatacagtacattcctggtttgtcggattttccaatgtggataatccggagctggcgatcagcgtctgtgtcgaggatgcggatacggcgaccattactggtgtcagtgtcgcaaagcaggtgtttgattcttactataataattaaaggtcaaggtgacagcgcacatgaggttttacaaaaatctttatgtcagcgagagcatgacaaaaaagaaagaaaaagtgattgcaaaactgaataaaaaaaagtatccgttgaatacttatgtgatcgcgctgatcgaagaaggggaaaatcagctggaattttattcgacgttgatgttccgacagggaagtgtgattgatgatgatattttcgttgtcggcatagcgggtggatatgatgatgcgctgtatctggtagaagagatcgcgaaggaagtttatgaaaaaacaggggatctggatatccggtcctacatcagagagcgggagagggaagaagaatgattctacatatcattggattgattttgaagattatcggaataattcttctggtgattctgggaattctgctacttgtgatcggtgtccttctctttgtaccgctgagatatgaactgcgtgccgagttcccggggaagctggaagatgcagaggggaattttaagatttcatggctgcttcatctgattgcaggaagagcggagtatcggaacggcgatgtgaaatggcaggggcggattgcctggaagaagttgggagatgttctggaagcggaagataaaccggtgagaaagaaggagaaaaagccggatggcggaaaaaaagccggtgcggagaatgccagtgagagaacggcagaaagaaatgatgcggcagatgtaaagaagccgcagacgctgccggaaaagagagccgaaagcggaacgtatgcaaagccagagcatacggacgtgaaagatgagaagtccaaaacagaaacacagggaagtcctgacacgaaggtgaaaacattttcagaaaaaaaagaagagaatgctacactggaaaaggaaagtgaatccagagaaaaaaaggatgttcatgacgaaagaggatccggaaaggctcacaaaactccacgaaaacggaagaaaccggtcaaagcatttggaaaactgatccggaagctcagccagaagctccgtgagatcctggaaaagatcaaatgtacatggaagaatttatgtgataaaataaaaaatatcgcagataaaaaagataaaattctggagttcctggaacaggaaaatcataaagcagcttttgcacgtggcaaaaaggaactggtctgggtgaagcgttttctgaagccgaaaaagcttcgcgtaaaactgcatttcggttttgaagatccttaccataccggacaggtactggcactttgtggaatgttttatgcatttatcggagaaaatatggatctggaaccggattttgaaaagcgggtactggaaggttccgtttatgtaaaaggaagactaagaacagttcatatggcagtatttgcagcaaagatgctgctggataagaatatccgcagcacttaccatgatatcagggagtttaaatggtaaagcattcgatagaaaataacaggaggaatcgaaaaatggcagtagataatcagtttaaagagacagtagatgcattgtttaaagggatgaacggtgtggtatcatccaaaaccgttgtaggagatgcaatccacatcggagatacgatcattcttccgcttgttgatgtatcttttgcaatcggagcaggggcatttcatgcggacaaaaaggacagaggagccggcggactcggcggaaagatgatcccgagtgcggtgcttgtgatccagaacggaacaaccagactggtcaacatcaagaatcaggataccatgactaagatcctggatatggtcccggatgtgatcgaccgttttaaatccccatctgaggataagatgaccgaagaggatgtggcagatctgttaaatgaagcagattctccggaaaatcaggaatagacgtaggtttctggcatatatttattgtaaaagaggaaaaagcaggaacgaagatgaaacgggtatttggttttgcactgttttttgtggcacttggtatggtgatcatgatgttcattccgagcatatttatcggaattctgatcgttctgctgtgcctccttgtcggatatcagcttttttgctgctgattttgaaaaaatatgagaacctgcaggggaaaccctgaaaaaagccttgcgtatgcagggcttttgtgatacaatgctaacgttgcaaaaaaacacgtgtgtggtttatcccggtggtgccaaagctgacaagcatggttcgcggacataagcacacggaagtaaaaaaccaatggaggaaagaaacatgagcgttatttcaatgaaacaacttttagaagcaggtgttcattttggacatcagacaagaagatggaaccctaagatggcagagtacatctacacagagagaaatggtatctacatcatcgaccttcagaaatctgtaggtaaagtagatgaagcttaccaggcagtatctgacatcgcagcagaaggtggaaagatccttttcgtaggaacaaagaaacaggctcaggacgctatcaagacagaagcagaacgttgcggaatgtactatgttaacgaaagatggcttggaggaatgcttacaaacttcaagacaatccagagcagaatcgctcgtctgaaagaaatcgaagctatgtcagaagacggaacattcgatgtactgccgaagaaagaagttatcgaaatcaagaaagaatgggaaaagcttgaaaagaaccttggcggaatcaaagaaatgaagagaatcccggatgctatctttgtagtagatcctaagaaagaaagaatctgtgttcaggaagctcacacacttggaatcccgctgatcggtattgctgatacaaattgtgatccggaagaacttgattatgtaattccaggaaacgatgatgcgatcagagctgtaaaacttatcgtatctaagatggctgatgctgtaatcgaagcaaaccagggcgaagcagaagaagtttacgaaggcgaagacgtagaaacagctgaagaaacaacagaagaataattcgaacaatccaaaagatcatattgaaagatggaggaaaaaatcatggcaatcacagcaagcatggtaaaagaattaagagaaatgacaggcgctggtatgatggactgcaaaaaagctctgaacgaatctaacggagatatggatgcagcaatcgaatacctcagaaagaacggcgaagctaaggctgttaagaaagccggacgtatcgcagctgaaggtattgttatggcagacgttaaagaagataagacagcagctatcgtagaagttaactctgagacagacttcgttgctaagaacgctgatttccaggcattcgtaaaagcagttgttaatcaggcacttactacaaaagctacagatatggaaggattcatggctgaagcttggaacgaagatgcttctaagacagttaacgatgcacttacagaaaagatttctgtaatcggagaaaagctcagcatcagaagattcgaaaagatcgttacagatggctgtgtagtatcttacattcacggtggcggacgtatcggtgttcttgtagaagctgatacagcagttgttaacgatgctgttaaagaagctctgaaaaacgtagctatgcaggtagcagctttaaatgctaagtatgtaagccaggcagatgtagatgctgattacatcgcacatgagaaagaaattcttcttgctcagatcatgaacgacccgaaagaatctcagaaaccggaaaaggttatccagggaatgatttctggacgtatcaacaaagagatgaaggaaatctgtctgttagatcaggtatatgtaaaagctgaagacggaaaacagtctgtagctaaataccttgacgaagttggaaaagctaacggaacaactatcactctgaagaaattcgttcgtttcgagacaggtgaaggtcttgaaaagaaaaatgaagatttcgcagctgaagttgcagctcagatgaacgcataatcttacagttcgcataagaatctgaaccgtatgattatcatgtaaatcaacgaaaaaccttgaatttcctatgaaaatgggataattcaaggtttttttgcgttgccaagcatgcgacaaaaaggtccggtggaccttttttagtgttggggaataaattttgacttatcgaaaattaccgctatttatgcatggaattgggtaaaagttggggagtgagttggggaatttcaatttcccaactggcgtgtgaaacttcgcctcattcttctaaaataagtaggcgaagattgcctgttttaatttgttagattctgttcttgcaagtacgatgatttccaacagtgagtatatcgtgatgcttaatcaggcagagccggacagagcaaaactggcaacactactaaatatctccacagaacagatgggatatatgcggtgaagagttgaaggttatggacaaagttacggagcgattgttgtggggagattatttatgtagaaataaaagaacgagagttcagtcaaaagattatatgacacagaaatgaacgaaaatttaagaaaatctaaatagtatttccaactgttttccagtatactgaaactataattggacattggaacttaagttatgtggtgagggtatagtgcgataacttagagggacaaattggatctggaaagtgttgcggcttccttattgaggcaatggagaggaaactcaggaatcgtggaagcctttgctgaacacgattcccgctttcagaggttcctcggaatggtttgccgaaggaaagccgcagcactttctatatacactttgtcggactaacttcaacaaacttttacaccttaaaagtagaatgatgaggagggaatgaaaatgaatgtaaatgggaatttcaaagacaatctgatggggaagaaaaaggtgatttttattggatgccttatttttgcagtcgctctgattgccacaatcctgcacatggtttcaggagggggaaaggattccgcgaagaacatctactacgcggataaagtcagcgtgatcaccggaaacggaagcggaaccgtgaaccgctttgcaggcgttgtggaggcgcaggatactttgaaaatctcactttcagaaggacagaaagtgaaagagattttcgtggaaaaagggcaggaagtggagcctgggacgaaactctttgaatatgatacagaggagcttgcaatgacactggagcagggaaatctggagctggaaaagataggaaacagtatttccaatctgaattcacagattgcggccttaacgacagagaaaaagaatgcaccggcaggtgagcagctttcttatacaacgcagatccaggagctgcagacgaatgtaaaacaggaagaatataattataaagtaaaagaactggaagtgaaccggacgaagaagagtctggaatcatccacggtgacatccacgattgcaggaattatccaggagatcaatccggatcctggttatgatgattacagtggagaaaaacaggcatttatgagcattctttctaccggaaaataccgaattaagggaaaaatcagtgaacagaatatcggtgagcttcagccgggaatggatgtgacggtgcgggcaaggaataaccaggaggaaatctggaagggatctgtggatgtgattgacacagaaaaaccggagagcagttcacaaagcgagatgtattccggttcggattcttctgcccgggcaactaagtatccattttatgtaacgcttgaaaccagtgatggtctgatgctgggacagcatgtatatatcgagcctggaaccggagtaaatacagagggattacatctgatgactgcttatattgtagatgcagacgggaaagagccttacgtttgggtagcaaataaaaaggacagactggaaaagagaactgtaaagcttggtgcttatgatgaggagcaggatacatgggaaattacagaaggactgaaagagacggattacattgtctggccggatggagaatgtaaagaaggagcagccgttcagaagaacgaaaatgtacaggcaggaggcatggaagagggggaataaaggatgacttttcaaaaaagaaataagaaaaaaattcttcagatcgggattgctttggttgtctgtgtatgtttcattggaggcggcactttatttgcaatgaaaaaaagtgaaaaagcggtcaaggtagcaccggtagccagtatgagtaatggtggatggtattcagaatcggatatttatgattatgcgaaggtgcaggcaggtgcgagccaggacatttaccatgatgatacccttacgatcaaggagatttatgtcaaatcaggggatacggtgaagatcggcgatcgtctggttgcctatgatactacgcttgcaggacttgagcaggaaatgaagcagatggagattcaggggattgaactgaatattcagaatcaaaaggcagaattagagcagctgaaaaatgcaaagattgtttcgtctgttgaaagaagccaggatgagctgcggaaaatgactgcaaaaggaaccagacctggaataatacggactgcggatacaaagaaaaatgaaggggaaaatccggatacttccgaaaatcctgagcagccggagacaccagaaaatccggaaggaccggaaaaaccatcaatcgggaaaccgtttccggaagaactgaaggataagatcatttataaagagattacaaaggacgctgctccttataatgaagatggagatggaacaaaagaaaagccgtatcgctatctttgtgcgccgggagcaacggtaaatgcggagttcatgctgaaaatgctggaagaaagggcagtctgtatctttgatgtagtggatcaggagaaggaaccgacgcttcttttatactcctggacgctggacggaaagaccggacaggtgataaagcctgaaaatccggaacagccggagacaccggaagagccgaaaattccggatgaaccggataatcctggtggatatgaggagccggatccgggagaggcagatggaatgaccagggaagagcaggcaaagcaaatccaggaaaaagaacagaagatcaaggacctggatctggaaaagcgaacagcacaattggaattgaaaaagctggataaaaaagtaaataatggtgttgtaaagagtacagtagagggaacggtaaaagctgtacttgacgaagaagaggcaaagctggagaataaaccggttatatctgtgaacggaaaaaatggttgttatgtaatcggagggattgccgaaagcagctatgataaattaaaagagggtatgactgtgatggtgacttcctggaatacggggaactcttatgaggcaacgatcaccagcatcggtaattcaccggttgaaagtatgaagagcagcgagaatcctaatatgtcctactatccgtttactgcagtggttgagaaagatgcagacctttcatctggtgagggtgtcagtatttccgtagacggactttcgggtgacagtgggaattcgatttacctggaacagatgttcataagagaagacggaaaccgctcctatgtatacaagaaaggaaaacatggaaggctggagaagcagtatgtagaggttggaaaaaatatgtacggttccattgaaatcgtttccggacttaccatggaggatgagattgcatttccgtatggaagaaatgtaaaagagggtgcgaagacaaagacagtggagtcattgtatgattataattaatgagggggtgaggagatgcttgaagatatcaggctggcatttcagggaatctggagtcataagctgcggtctgcgctgacgatgcttggtattattatcggaatcggatcgatcattgcaattgtttcaacgatcaaaggaaccaatgagcagatcaagaaaaatctggttggcgcgggaaataatgcggtcaatatccagctttatcagggagactggacactggatctgtcttatcaggaggttccggatggaataccggagatttcagatcaggtacttggtgagatccaggcactggatgaggtggaaagtgcagccctttatcatagacggaatgaatatgatgctgtatatgcaggcagtcagaagttggcaagctgtaatatttttggaatagattccaattatctggatgcctatggatttcagatcacaaaagggcgtggcttttccgaaaaagattttactgcaaaccgaaaagttgtgttgcttgataaaacgacagccacagctctatttccggatggaaatgtgattggaaagattattgaggttaaaggggagccatttacggtgatcggtatgatggcgagaaaagaaaattcgcagccggtgatcaattcgatggaagactattatcgttatgtatccacggatggaagcggaacgatctgtattccggatacactgtggccgattatttatcagtacgatgaaccgcagaatctggttgtccgtgcgacaagcacagatgagatgactgcggcaggagaaaaggcggcagatatcctgaacagttacctgaccgtgtctgatgagacgataaagtataaaggggaagatcttctggaacaggcgaaccagatccaggagatcagcagctcgacgaaccagcagctgctctggattgcaagcatttcacttctggttggcgggatcggtgttatgaatattatgctggtgtctgtgacagaaagaacgagagaaatcggtctgaaaaaggcactgggggcaagaaaaagaaggatcctgacgcagtttctgacggaagcggcagtacttacccttctcggaggtctgatcggtgtggcaggagggattgcgcttgcctatattatttccgcagtctcggcagttccggtggcaatcagcggagtgtccattctggtcggagtagtattttccacactgatcggaattattttcggactccttccgtcggtgaaggcggcgaacatgaatccaatcgatgcactgagaagtgagtaggtttatgtagagaagaattatttgtcggatccaagattgcagacaaatagatagtatctgttctgcaggaaagtggcgtgccttactggcacgccatttttaaaaattcttccattgcccttgtctggtagcgaccatttttccagtagaaccggatgtcacggctgctttcgcctgcaggaagcttatagtacaccacatcagaggtaagaggtacttttgagagcatgatatctccgataaaagagatccccatgccggagcaggtgatgttgtaagaagtcatctgctgatccatttccaggatgatatttggttcaaagagattgttccggcagatcatacgggcacgttttccagtgtcgttttccggtttcagcataataaaaggctcacttttaaagcgtgtcagaggaacgggaggacaggattcttccagaaattttttgctcaggatatcttctacaggaagctgataggagcgcagcgtattattgatcgggaatgctcccggaacagcaaggatcaggtgctcttcctgaaatttacggcagctgtagatggtggcatccagaacactgctgtccagcatcagatccagctgcccgtgtcgcagcatacgggcaagattggcagtggtttcttcaatcaggctgatctggatcagaggatatctgcgggcaaaatccgcgatcagcggaggcaggatccaggaggaaaacaagttgcttcctccgagggtgagtgttcctttttttaggtcgccccagtcgtttgcaaatccttcaaattcattctggatactttttattttttctaccgctttgatatactgtaccccacattcggtaagggaaagtggtttggtactccggtcaaagatcggatatccgatgtgatgctcgacacgctttacgttggcactgagtgaaggctgtgagataaataacttctcagccgccttagaaaagcttttttccagataaacttcatagacatattccattccctgaaacataggtattctcctttgacatagttttaaaattatagttactataaaaatatatgtattagattatattgtaacacagagctataatgaaaacaacaaaggcaatacgccagagaaaaatggaaaatcgagggattttgagatggaaaatggaaaagaaaacaagacaggttatcgtgtagaacaggattcaataggggcaaaagatattccaggagatgtatattacggggtacagtcactgcgtgctgcggagaatttccgtattaccgggctgaatatgcatccggagatcatcaacagtcttgcgtacataaagaaagcatctgcgatcaccaactgcgagagtgggattctggaaaagaaaaaggcaaaagcaatcgtacaggcatgtgatgaaatccttacaggaaaattgcatgagtactttatcgtagatccgatccagggaggtgcgggtacttctctgaacatgaatgcaaacgaagtcattgccaaccgtgcgattgagattcttggcgggaaaaagggagattattcagcaataaatccgaatgatgatgtaaactgcggacagtccacaaatgatgttattccgacagctggcaagatgacttcactcagacttcttcagaatctgaaaaaagaactgctcagacttcatggagcgctctgcaaaaaggcagaggaatttgaccatgtgatcaaaatgggacgcacccaaatgcaggatgcagttccgatccgtctgggtcaggaatttcaggcatattccgatgccatcatgcgtgatatccaccgtatggataatgcgatggacgagatgcgtaccgtcaacatgggtggaacggcagtcggaaccggaatcaatgcagatgaagcctatgtaagccgcattgttccgaatctttcaaaaatatctgatattcagtttgtccaggcttttgatctgatcgatgcaacccagaacctggatccgtttgtggcagtatccggtgcagtgaaagcgtgtgcagtcacactttccaagattgccaatgacctgcgtctgatgtcatccggaccaagagccggatttggtgagatcaaccttccggcaaagcagaatggttcttcgatcatgccgggaaaagtgaatccggtcatcccggaagtagtgaaccaggtcgcatttaacatcattggaaatgatgtgacgatcacgatggcagcagagggtggacagctggaactgaatgcgtttgaaccgatcgtattctactgtctgttccagtcgatcgatacacttgcatatgcagtgcagacttttattgacaactgtgtgacaggaatcacagccaatgaagagagatgccgtcagctggtagagaacagcatcggcgtaattactgcaatctgtccgcatgtaggctatgagaaagcagcggagattgcgaaaaaagcaatgaagaccggggaatccatccgtaatctgatcctcagagaaggtcttttaagtgaaaaagagatggaaaccgttctggatccggtcaatatgacagagccaggtatttcgggaaaagaacttctcagaaaataaagaataaaatttttctaaaagacatgattttctccttttaagggtgtacaatgaaacatacgcgtttcatgagttacaacttaaaaggagaatttttatgcttcaaattcaacatatctgcaaagaataccgtacaggtacgctggtacagaaggcactggatgatgtaagcctgaatttcagggacaatgaatttgttgcgatcctgggaccgagtggttcgggaaagacgacgtttcttaacatcatcggtggactggatcggtacgatagtggtgatctgatcatcaacgggatttctacggaaaaatataaagacagagactgggattcctatcggaatcatacaattggttttgtatttcagagttataatctgattccacatcagacggtgcttgccaatgtggagctggcactgactatttctgggatcgggaaggaagaacggaaaaagagagcgattgaggctctgaaaaaagttggtcttggggagcagttgcataaaaaaccgagccagatgtcaggcggacagatgcagagggtggcaattgcccgtgcgctggtcaatgatccggatatcctgcttgctgatgagccgacaggagcgctggatacggcgaccagtgtgcaggttatggaacttttaaaagaagtggcaaaagaccggcttgttgtaatggttacacataacccagagcttgctgaagaatatgcgacccgtatcgtaacgctcaaggacggaaagatccgttcggatacggacgaattttatgtcaatgaagcggtcatgaaggagccggagcataagaatatggggaaagcttccatgtcatttctgacggctctttccctgagctttaataacttaaagacgaagaaagcaaggactcttctgacatcttttgccggttctattggaattatcgggattgcactgatactggcactttccaacggagtcaatgcctacatcaagtcaattgaagaagagactctttccgagtatccgcttcagatccagagtaccggatttgatatgacatcgatgatggtaggcaatatggacagtggttcgggcagttcggataagaaggagacaaaaaaagacggggaagtcaaggttatgcagatgatgaccaatatgttttccacgatggattccaacgatctgaagtctttaaaagaatatctggatggaggaaaaagtggaattgaggactataccagtgccgttgaatattcttataatatttcaccaagaatctatcggcagaacaaggatggttccattcgccaggtgaatccggacaaatcctttgagtcgcttggaatcagctctggcgcaagtaccaacagtctgatgtcatcgatgatgagtacgaatgttttttatgaaatgcctaagacggaggggctttatgagaaccagtatgatgtgaaggcgggacgctggccgcagaattataatgaatgtgtactggtgctgacttcggacggaggcatgagtgattttctcctttatactttgggactgcgggatcagatggaactggacgaaatgatccaggaatttatcaatgaagaagatgtgaacactccggcaaatatcggaacatatacctatgaggatattattggaaaaacttttaagctggtcaatgtgtctgactgctacgaatatgacagccagtacaagatctggaaggataaatccgataataaggaatatatgaagaaactcgtggatcagggcgaagaacttaaaatcgtcggaatcgtacaggcatcggaagatgcaaatgcttccgctctgacaccggggattggctatccgcagagacttactgagcatgtcgcaaaagaggctgcaaaaagtgagattgtaaaggatcagctgaaaaatccgtcaaagaatgtatttactggagaaccgttcggaaccacagaagagaagaacggactggatgcgaacagtctgtttacggtagatgaggatgcacttcagaaagcatttgttttagacgacagtggatttttcggtgatatgttgtcagcagattccctgaatctggaaaatgcattccggatgggtggggattctctggatctgtccgggatgataaatctggatcggatcagtcttgacgtgtccggtatgccacagatgaatcttggcgatatgatcggaagcctgaatcttaccgtaaaaccgggtggaatgcagaagttgtctgagagtgttatggaaggttatcaggagtatgtgaaattccattcggaagcagattattcaaatctggcgagagattttatggattacctgatgacggatgaagcgcagaagatcctgaaagataatctgcaggagatcattgagagcaccggtggttttaagattacaattgatcagatgcaggagcttgtacagcgtgtgatggaaggatatcaaaagtatgctgcggaaaaaggatatacagatccggataaatttggagaatacctggcggagtatttacagaccgaggaagcaaaagagattatgaatgcctggcagcaggagatttttggagatacggtgataaatattacttctgaccagctgaaaaaactgacaaaagaactggcgagtagttatccggcatatgctgcggcgaatggaaaagcagatccgaccaaaatgggagattattttctgaactaccttgctacagcagatggaaaacagcgtctgatgaacgggctttccgaggtgatcgatatggatcagctggagagccagttaagtgcgacaatgggaagttacatggcaaaggcaatgggaacttatacccgagcaatttcggatgtgcttgagacacagatcacttcggcaatgaatcagatcgtcagtcagatcacagaaaaaatcgggaacgccatgcaggctgccatgggaaatgtgggaacccagttgcagaacatgcttggaagttcgatgaagattgataccgatgcatttgcaaaggcatttcagatgaatatgacagaagatgatctgaaagagttgatgacatccatgacaatgagcgcgactgcttcctatgacaataatctgcagaagcttggatacgtggattttgcgaacccgagtcagatttccatatatccgacggattttgagagcaaagaaaaagtggtgaaaatcctggattcttataacagccggatggaaaaagaaggaaaagaggaacagatcatcacttataccgatatagtcggaacactgatgtcttccgtgacaaatatcgtggatatcatcagctatgtgctgattgcgtttgtggcgatttcccttgtagtatcttcaattatgatcggggttatcacctacatcagtgtactggaacggaagaaggagattggaatcctgcgcgcgatcggggcatctaagagaaatgtatcgcaggtatttaatgcagaaaccgttatcattggtctgtgtgccggactgatcggaatcggactgtcactgttgcttctgatccctggaaatatgatcatccatgcggtggcagataataacaaaattaatgcatttttaccagtgcttccggcaattgtgctgattcttttgagtatcgggcttaccctgctcggtggaatcattccgtcaaggaaagcagcaaagagcgatccggtgacagcgcttaggacagaataaaaaaagagaatgagggaaaaggaaaatggataaagagaaaaatacaaaagcagtgagtgaggaaaatatttactgtctgaatggaagagtgccggtaaaaaaggcgattccgttcggactccagcatgttctggcaatataaggaactggcggcacgataaaaagtgtcgccagttcttttttagtgtggaagtgaccagttccagaagcttgttcattatatttgaccagcttggaagtatttgctgtatagagcattggaatcaatgtagcagcgtcctggaattgctgcatttcttctggtgaaaatccggttgtgccgcataccagggctttttgtgtttcactacgagggagagtacctccagactggtttctctggtagaaaaatcgatgatgacttgaccggatccgcaccgaatattcagtaagctatgattccaattgtaagaactaaaaaatcatgctatacttacggcagatgaaaaactgacaggataagacaacaaaggagaggcacatgaattctaattttgaatattataaagttttttattatgtggcgaagtatgagaaccttacaaaggcatccagcgttctgaagacgagtcagccggcggtgacgagaacgatacacaacctggaaaatgaactgggatgtcggttatttaccagaagcaaatccggcatgaaactgacaccggagggaagaaccttttacagctatgtatcggcagggtgcgcccagttttttaaaggggaaaatgatctgagcaatctgatcagtctggagaacgggacaatctatatcagtgcgactgagacagccttgcactgcttcctgttccgggcaatgggagagttcaacagcatttatccgaacgtacatttcaaaatcttaaataacagtaccatggactcggtcaacgcggtaaaagaaggaaaggtagaccttgcatttgtgtcaacggatctgcaggtaaataagccgctcaggatgaagaaactgcgggaataccatgaggtgctgatcggcggcagtcgttacatagaattaaaaggaagaaagatttcattggaggagctttcggcttatccttggatcagcctgacttcggaggcactgaccagaaaattcctgaataattattttgcagatcatggtctgcagtttttgccggatatggagcttgcgacgacagacctgatcttgccagcagtccgtcacaatcttggaattggatttgtcccggaagaatttgccgaagaagagaagaaggcggaaaatgtatttgaaatcgaagtggaagagaagcttccgaccagaaatattattctgatctatgatactgagtatcctcagagtattgcatcgaaggagtttcagaagtttctgagcagtcagaagaactaaagaagaaatagattttcaaagtggattgtgcaaatcggtatcctttgtagccgggatgtgtatctgcaaagaaaaatataaggagaatgccccggaattttttatgtgtggatcataaagttccggagcatttttatatttgtaagtataaagttataaagtagaattttagattagaaaacgattgatattatttatgccattcccagtttctgatttcttccagatcctgtccatattcagcgatgtactgcttgtgctcaaccagtttgtcgttcatcttctgaatcaggaatgatcccttattgccaagctgtggcagatgcatgattgcatcttttacaaggttgaaacggtcaatctgattctgtacacgcatgtcaaatggagtagtgatcgtaccttcttcctgatatccatgaacagaaatgttgtggttgtgacgttcgtatgtcagctcatgaatcagtgtcggatatccgtggaatgcaaagataaccggtttatcttttgtgaagattgcatcgtattctgcatcacttaatccgtgtggatgtttgtggtctgattccagtttgaacaggtcaactacattgacaacgcggatcttgagctctggcatttcatcacgaaggatagtaacagcagccataacttcaagagtaggagtgtcaccgcagcaagccataacaacatctggttcttcaccgcagtcattacttgcccattcccagataccgataccctgtgtacaatgctttacagcctgttccatagtcagccactggcaacttggatgtttagacgctacgattgcattgacatagttcttactcttgatgcagtggtcgaagcatgagagtaagcagtttgtatccggtggtaaatacatgcggacaacgtctgcctttttattggcaatgtgatccagaaatcctggatcctgatgtgtaaatccgttatgatcctgttgccatacattagatgtcaggataaagttcagcgaagcaatcggctgtctccatgaaagctggttgcagaccttcagccattttgcatgctgtgctgccatagagtcaacgatacggatgaatgcttcatagcttgcaaagaatccatgacgtcctgtcagaagatatccttccagccatccttcacacatatgttcacttaacataccgtccatgatacgtccgtctcttgcaaggcagtcatcagtgtcaagcaagtctgcctgccagtcacgtttctgttcttcaaatactttgtacagacggttggacatactttcatctggtccgaagatacggaagttcttactgtcttcatttaatttgaagatgtcgcggatgtatccgccaagttcgatcatatcctgcgcttttgtcttgccaggttctacttcgattccgtatgagcggaaatccggaagacgaaggtctttcagaagaagtccgccatttgcatgcgggtttgcaccaagacgggcatctccctttggagcaagttctgcaagttccggaatcagatgtcctttttcatcgaagagttcttctgcatggtagctttccaaccattctttcagaaggtcaagatgttctggtgattccatagaaagcggtacctgatgtgcacggaaagatccttcaatctgaagtccgtcaacaacctttggtcctgtccatccctttggagtacgaagaacgatcattggccagaacggacgggtaggatcattgttttcacgggcatttttctggattgctttgatttcttcgatgcaggcatccatagtttcagccatttttctgtgcatagtcatcggatcgtcaccttctacgaagtaaggtttccatccgcagcccttgaagaagttttccacttcctcatgagaaatacgtgagaaaatggtcgggttactgatcttgtatccgttcagatgaaggattggaagaacagcaccgtctgtgatcgggttcaggaatttgttggactgccatgaagtagcaagcggccctgtttcagcttcaccgtcaccgacaacaactgtagcgataagatctgggttgtccagaacagcaccaaagccgtgagcaattgaatatccaagttctccaccctcattgatagaacctggtgtttctggagcacagtgactcggaactccgcatgggaatgagaactgcttgaacattttcttcatgccttcctcatcctggctgatgttcggataaacttcactataagaaccttccagataagtgttggcgatcaggaagtttccgccatgtcccggaccggaaagaagaatcatatccagatcataacgtttgatgacacggttgcagtgtacatagatgaagttttgtccaggtacggttccccagtgtccgacgatttttttcttgatctgatccatggtcaatggctttttcagaagcggattatcaagaaggtataactgaccggctgacaggtagttggcagcacgccagtaggcattcattttgttgagcagttcatcagataatggctgcttttcaagacataatttattgtcttccattttagtacctctctctttctctagttcatttttgttatttttttaactgggttcatcatatcatgagtaaaagataacgtaaaatagcaataatgaattatattcatatcaaaatgttatggataggaagaggggagttccttaatttcgtaataggtagtagacagtgtgaaaaaattgaagtataattatgaatagctgtttttatgtaagatttttgaataaagcgtttaaaatgtaatgttttgacagaaaaaaacagtgtatatgatgtagattgacagttttttagtgagggagaatttattatgaagactactctgattattatggcagcaggaatcggttcaagatttggaacaggaatcaagcagctcgccaagatgtctccgaatggggagatcattatggattactctatttatgatgcaaaagaagctggttttgacaaggttgcatttattatcagaaaagatattgaagaagaattccgttctgtaatcgggaatcgtatcggagatcagatcgaggtggaatatgtatatcaggatcttgcagatattccggctggttttgaagttccggagggacgtaccaaaccttggggaaccggtcaggcagtcctgtgttgtaaagatgtagtaaaagaaccgtttgtgatcatcaatgcagatgattattatggaaaggaagcgtttaagcttctccatgattacttgattgcgcacgcagagacagcagataagatgcagatgggaatggctggttttattctgaagaatacggttagtgaaaatggaacagttacccgcggcgtatgtgtggtagatgaaaatggaatgcttgaacagatccatgagacgactggaatcagtatccaggctgacggggtacactgcgacagcgaagcggttcagaaatggatcacaccagattctaatgtatccatgaatatgtgggctggttatccggatttcattcaggttctggatgagagattcgcagaatttttaaaagatgaagcaggagatcctttgaaaaaagaatatcttcttccaaatattgtaggagatcttttaaaagaagaaaatgtggatgtaaaggttctggaaacacacgataaatggatcggtattacttataaagaagatacagaacttgcacaggccggattcaagaagatgacagaggatggcgtttatccggaaaaattgtggaattaaacggatcctggaagtaaaaaacagaagaggaaagaaaaatatgaatgaattaaaacggttagaggcacagagagatgacgagatcgagattgatcttggcgagatctttcatttattgctgaataaattatgggtgattattctgtgctttatcgtaggtggagtgattgggtttgccggaacaaagattctggtgacaccgcagtactcagcttcatcgatgatttacattttaccaaagacaagaagcgtgacatcccttgcggatatcaagatgggttcacagctgacttcggattttggaatccttgcaaaaagccgtccggttattgaagaggtcaataaaaatctgaaactggactattcatatgaacagcttgcttcgatggtacaggcaacgaatcagtcagatacacgaatcctgcgttttacagtgacagatactgatcctattgaagcaaagaagattgcaaatgagcttgcgaatgttgcagcagagcgtgtagcttacgttatgtccagcgacaaaccgaagatcgtggaagaggcggctgttccgaaatccccatcttcaccaaacacaaagaagaatgcaagtgtcgtggctcttgtgtttgcttttgcggcagcagcaatcattgtactcagatatttgctgaatgatacgatccagaatgaagatgatgtaaaaaaatatcttggacttcatatgcttgcagcgattccgacagaaaagagaaaatcgatttgaaagacaggacaagaaagattattgttgcggtgttgcttgtgatagcagtctgctgtgcaggttatctgatttggtattacgccacggcggcaaagacgaagcagtcgtatgatgatgcaaaaaagctggtaacggaaaatgtgaaaccgtcaaaaacagatagtgatgacggagagcagacaaagccggagataccggttgattttactgctcttcaggaaaaaaatccggacatttacgcatggattaaaattgatggaacaaccgttgattatccggtttgccagaataatgaggatgactggtaatcgtgatacttgcaattatctgcgcagggctgttggcaggtgtcgtttatacggttacaaaagggaaaagcggtacgcagaaaaaacaggaggcatcggcagaagcgggtgcagacgaaacggaatcacagtccggaatcatcggagaagacggaaagaaatacaaacagacattaagactgaagccaaattgaaagaagtacttggaagcgattttaatgcgaacatgacagttgctgatgttaaggaagttacagcaccggaaggagctaaactggcagcagtagcagcatttggtcttaaaaagaaagttgttagataatttacaaacatatgttgaaagcacttctttgtggcggtagtcaccgtgaggggcgttttctttttgacaggagagatacgttttgatgttggtagatattcattgtcatattctcccgggagtggatgatggggcaccggatatggagacttccagagcaatgatacgggatgcctatgagcagggagtacgttatatcattgcgactccgcattatagaccggagatgtttgagccttccatgaaaaaggtgatccgggtataccatgaacttcgcgattatgctgaagaagttggaattggactgaggcttggctgcgagtattaccggaatgagcagatgatccggcatcttgataagaagcttcgaccgacgatgcttggaagcaggtatgttttgacagagttttcaaccaatgacagttttgtcacggtccgtaattacatttatgagctgatcaccaagggatatcgaccgatcgttgcacatgttgaaaggtatttttgctgtcaggaaccggagagaatccagaaactgaaaaaacttggagcacagatccagataaatgcagattccgtattgggatatgaaggacatacgattaaaaagttctgtgccggcctgatgaaagatgatcttgtggattttataggatcagatgcacacaatctggaggggcggaagatgaacctcgggaagtgtgccacttacgtcagaaaaaagatgggacaggattatgcggaagagatttttgtagataatccaagacggatatggaagagcagataaagagattcagatagccccgcgtggggaagaaagcaggtgttttgttgaaaaaggttaatttatcgattgaaaagaaaagctacggggtgcgtgaatcaatccggacattgcgtaccaatctgcagttttgcggagatgataaaagagtcattcttgtaacaagctgtgtgccgagagaggggaaaagctctgtttctgttgcgctggcagaatcaattgcagacatgggaaaatctgttattcttgttgatgcggatatcaggaattctgttatggcatcgaaacttcagattaccggtgcagataaagggctgtcacacttcctctccggacagtgtgtgcttgcagatgtgattatggcgacaaatattccgaaatttcatattcttctttccggaccggaggctccgaatccgacagagcttctggaatccgaacgttttactggtatgctggagtccatgaagaatgtctatgattatattatcattgactgtccgccgcttggtcttgttattgatgcggcaatcatcggacatcagagtgatggcgcgatcattgttgtcgaagcaggtaaggtcaaataccgtctggtgcagaatgtaaaagaccagctggaaaattcgggagtgtccgttcttggtgttgtccttaacaaggtagagcgtaagaaccagaagggatattataacaaatattatggctcacagaagtatgaggactattatggacacaatgaagaaacaaaaaatgcataaaagtgaaaataacacttgcaattgttaaaagtttctgttaaaataactattgttgtgagtctgcaagatttgtaagcggacatttcagatcgttaggaggtgcaatcatggctaaatgtgctatttgtgaaaagggtgctcatttcggaaataacgtaagtcactctcatagaagatcatctaagatgtggaaatctaacgtaaaatccgttagagttaaaacggaaaacggcggaacacagaaaatgtacgtatgtacaagctgcctgaaatccggacgcgttgaaagagcttaatctgagcggaatgatgagaaccgaagcttttaagcttcggttttttgcgtatacgatgagccaaatacggagctgtccagatttgtgctcgcacaaaaatttgattggatctgtatttggcgaatgtacgacagtgaactgttaagtgagctgccgtataatcaggcaggtgtcagcatgcctgattatcgggctgcattggttgtaaaagcattggaaatagagtataatattttcaacgtttaaaaatagatttattgatatgaattttgagaattggaggatggcatatgaagggaagtatgagtactgatttaggaatcatcacgatcgatccggaagtgatcgcaaaatatgcaggatctgtagcagttgaatgttttggaattgtcggtatggcagctgtcagcatgaaagatggtctggtaaaacttttgaaaaaagaaagccttacaaagggaatccaggtcggaatctctgatgagaataagattacacttaattttcatgtggtcgtagcttacggagtaagtatttcagcagtaacagacaatctgatcagcaacgtgaagtataaagttgaagaatttacaggtatgagcgtcgataagatcaacatctatatcgaaggcgtccgcgtgatcgattaattaaggaggaacttgttgtggcaacaaagagtatcgatgtagaactgcttgcgaagatgtttcttgcaggcgcacagaatatagaagcaaaaaaggaatatatcaatgaactgaacgtgttccctgtaccggatggtgatacaggaaccaatatgtctatgacaattatggcggcagcgaaagaagtaactgcactggaaggcatggatatggcttctcttgcgaaggcaatttcatccggttctctccgtggtgcaagaggtaactccggtgttattctatcccagctgctccgcggattcacaaaatccatcaagacggaaagcgaaattgatgtacctgcacttgcaagagcagctgtacgtgcaaaagagacagcatataaggctgttatgaagccgaaagaaggtacgattcttaccgttgcaaaaggggtggctgaaaaggctcagacacttgcagaggagacagatgatctggaagaatttctcccgaagctgattgaagaggcagagactgttctggcaaagactccggatatgcttcctgtattaaaggaggcaggtgttgtagattccggcggacagggacttctggaagtactgcgcggggcatatgatgcattcctcggtaaagagattgactacagcgcacttgcaccaactcctcaggctgttaatgcaacaaaggttgaaactgagggtacagtggatatcaaatttggatactgtaccgaatttattattcttctggataaagaatttacagaaaaggatgaaatagaatttaaggcttatctggaatccattggtgattctatcgtatgtgtagcagatgaagacgttgttaagatacatgttcatacgaacgatccgggacttgcaatccagaaagcacttacttatggacagttatcccgtatgaagattgataatatgcgtgaagagcatcaggaaaagctgatcaaagatgcagaaaagcttgcagcagcccagaaagagaaagaaaaagccaaagagccacgtaaaaaggtcggatttattgctgtttcgatcggagaaggattaaatgaaatcttcaaagaacttggcgtggactacattatcgaaggtggtcagaccatgaacccgagtacggaggatatgctgacagcgatcgatcatgtaaatgcagactatatttacattcttccgaataataagaatatcgtaatggctgcaaatcaggcgcgtgatctgacagaagacaaggatattatcgtaattccgacaaagaccgttccgcagggaatcacagcagttctgaattacaatgcagaagaagatgtggatacaaatgaagagacgatgctggaagcaatcaaatgtgtaaagacaggtcaggtgacttatgctgtccgtgatacccacatcgatgataaagaaatccatgaaggtgatatcatgggaattggtgatgcaggtatccttgcagttggcaagtctgtcgatggtactacaaaggacatgctggcgcagctggtaaatgatgattctgaactgatcagtctctattatggagaagaagtttccgaagaagaagcagaaaagctgacagcagagattgaagaattatatccggatatggacgtagatgcacacatgggcggacagccgatttattactatgtgttggcggtagaataggcttatgaatgagcagtcagaaatccgtaacctgaaaggaatcggggcaaaaaccgaggaactgtttcacaagatgggaatttttaccatcggcgatctgctccgttattatcccagaggatatgatgtatatgaagagccggtaagcgtaggagagctggaagaaggaaagatcagcacggtaaaaggtgtgatatatggaagagtacaggttggaggaggaaagcgtatgcagattacgacagcatacgtaaaagatctgactggtactttgaaggtgatctggtttcgtatgccgtttctgcgtaatacattgaagcagggaatgccggttatcataagaggacgggtagtttcaaaaaaggatcagctgattatggagcatccagagttattttcaccaccggatagttacgataaaaagtgtggaactcttcagccaatttatccgttaactgccggtatgacgaacaatgcggtagcaaaagcggttaaaggtgcgatggaatatctggatctcgtctctgatgatctaccgaaagatctgcgccttcgatatcatctggctgagtataactatgcaatccgcgggatacattttccactggataaggcagaattctaccatgcaagagagagacttgtatttgaagaatttttagttttcgtgcttgctcttcgaaggacgagggagcgaaatgagcgtgccgaaaacggatttgtgataaaaaggcggtcggaaatcgaccgctttcttgcaaatctgccatatgaactgaccggagcacagaagagagtctgggaacagatccaggaggagatgtgcggaaagctagtgatgtcacgcctgatccagggggatgttggctctggtaagacaatagtagcgcttctggctcttcttctggcggcactgaacggttatcagggcgcaatgatggctccgacagaagttctggccaagcagcattacgaatcaatcatagagatgctggaaaggtatcagattccggtgaaaaccgagctcttgaccgggtcgatgacagcaaaggaaaaaagggaagcttatcagaggattgctgcgggagaagtgcagattgttctgggaacccatgcactgatccaggagaaggtggaataccagaatctggcacttgttgttaccgatgaacagcaccgatttggtgtccgtcagagagaggcacttgccgggaaaggacaaattcctcatattcttgtaatgagtgcgacaccgattcctcgaacactggcaatcattttatatggagatctggatatttcggtaattgatgaacttccggcaaaccgtctgccaatcaagaactgtgtggtggataccagttaccgaccgactgcttaccgctttatgcagaagcaggtcgccgaaggaagacagtgctatgtgatttgtccgatggtagaagagagcgaggcaatggatgcagagaatgttcttgactatgcgcagcttctgcaaagtgagatgggtgacaagatccggattgctgcgcttcatgggcggatgaaacaggcagaaaaagacgagatcatgggagcatttgcaaagaatgagatccaggtcctggtgtcgacaacagttatcgaggttggtatcaatgtgccgaatgctacggtgatcatggtggagaatgctgagcgttttgggctggcacagcttcatcagctccgcgggcgcgtaggacgtggcagacaccagtcctattgtatttttatgagtggttcgaagacgaaagagacaaaaaaacgacttgagatcctgaacaaatccaatgatggattttttattgcgaatgaagatctgaagcttcggggaccaggagatctttttggaatccggcaaagcggattaatggatttccggatcggagatgtgttccaggattcggagcttctgaaaaaagcaggagaagcatcgggggaaatcctgagggaagatccactgttagaaggcgaaaaatataaactgcttggtgaaaagcttgcggcatacatttcgggaaacaatctggaaacgacgttgtagataaaaagatagtgggcaaattgttctgcccactatctttttattcataaaaccagtaaataataaatttgttaagggatgcttcttcactgtatgaataagaaacctgccaaagtccatatagctcacccaggtatcctgcaccttcttccatgagggtttcgtgcatttcatccacgacctcctgatagactgcatcatctgacattttaaatatcgtataagcctcctggctctcaatcgatctgtcgatcacttctcgcaacataccaggctcataggtatcataatacatgccgttcagctgataatagttcagattttcagactgacatgacggatatacatagtctgtgctgatcatatgtgttttttctagctctttttcactgcagcagagataatcgtaagcaatcaggttcggtatctgatagccattatcttcgccgagaaaaatcggatctccccaggttgcatctacataataatactgaccattgcactgaacaatattccatgcatggtctgcgatgcctccatttggatctgtagtctgtccggttacatagatacagtaaatacccagttgttgtagcagatactggcagctttttgcatagccggcacaaaccgatctttttccgacaagagcactgtaaatattctggttatccggtgcatcaagatcataatctacgttatctatgagataggtgtaaatgtattttatcttttcgtattcatctgaaaggtctgaaatgccagaaagacaggtggctcttgccgattcaatctcttgattccgttgttctttttcttctccctcataaagataattgggttctattactacatatcggctctggccttcagactgagaatattctgtggaagttgcatttccatcacaccagaaaatttccggtctgtcatttaacacattctgaaatacttcatttgcagtattcgcgttgctgcaatgcagataaatttcttttttattttcctggataccctgaagaatttcccggtaaaccgtttgctcttcagcagaaagctgttcatagtagaattctccggtaacctctgcatccgtaattttttcctgttcataaggaacttcttccggcgcggaactctctgctttcggagtggctgacatttgtctgccgatcaggattcctccggatataagacagagacagccaagtcccaaaagaatgaacgaaaaaaatttccctgtttgatgcatcttttttcgcataatctatttaattcctccaaatactcatctgtatgtttcatcataacatacccttcatttttgcacaacacggacattttttacatataatgtttctgacagtataaaaagccttgaggatatcagatatgagatttttgaaagctatgcagacttctgatcggggaaatttgcagatacagattacttcgtctattgattcttttcctgttccagatgcgtcaatccgtatttcctatacaggtattcctgaaaacacactggaagaactgacaaccgatagctccggacaaagtgaaaccattgagcttgacgcaccgcctgtggagtatagcctggatgtaacaaatgaagaacagccatatgcggaatataccctggaagtaaacgctccgggattcgagccggtcaacatcgcaggaacggaaatactggccggtgtgacggcaattcagaagattcgtctgcgtccacttgtcacggaagaccagaccccggaaatctttgtgattcctgcacacactctgtacggtgtgtatccgccgaaaatcccggaaaacgagatcaagccggtaaacgaaaccggtgagattgtgctaagcagagttgtcgtgccggaatatattgttgttcacaatggctcaccacgcgattctaccgcacagaattattatgtaaaatataaagattatatcaaaaatgttgcttccagtgaaatctatgcaacctggccggaaaatacgatccgggcaaatgtactggcaatcatgtcttttacgctgaaccgggtttacaccgaatggtatcgcaatcagggctatgatttcacaattacatcttctacggcttttgatcacaaatggattccggaacgaaatgtttttgactccatttctacagtggtggacgaactgtttgcagattatctttccagaccgaatgtaaggcagccgattctgacacaatactgtgacggaagacaggttcagtgtccgaactggatgacccaatggggttctaaagcacttggtgatcaggggtattctccgtcggaaatcctccgctattattacggagatgatatttacatcaataccgctgaagaaatttcaggcattccgtcttcatggccagggtataccctttcccagggttcttctggtacaaaagtccggcaaatgcaggaacagctaaatgtcattgccggtgcatacccggcaattccgaaaatcacagttgacggtatttatggtccggcaacagcgtcgtccgtcagaaaattccagtcggtgttcgggcttccggtaaccggaactgttgattaccgtacatggtataaaatttccgaaatttatgtaggtgtatccagaattgcagaattgtcctgacttggattttatattatgatctaagttttctcccaaagtctgcttttatgcaaagaataccaaatgtgtcatgcttcagtttaaaatgtttcatactcatctggtgcagattactgcaaaataaaaaatgctaaaattaacaaaacctcccagtgtaatctgaatttattctccatatactaggagcgtaacacaaaacaaaatgttacaaaaaaggaggaaatgaatatggcaagtcgttcatcaaacagagcagccgtgccagaagcaaaaggtgcactggacaaatttaaatacgaggttgcaagcgaactgggagtaccgttatcagatgggtacaacggagacttaacttcaagacagaacggatctgtcggaggttatatggtcaagaaaatgatcgaagaacaggaaaaacagatgtccggtcgatagggacagtcagtgaaggtatcacaggcatttctgccggatacaaaaagggaatgtctgataaacaggcactccctttttctctgatcactaagctggaaatcggacttgaaccgacgaccccttcattacgagtgaagtgctctaccgactgagctattccagcattcgtactgcttttgcagtcacgaattatattatatcaaatttttgaataaaagcaactcttttttaaaaaaattacactttaaaataaacataaaaaataggtattgaaatctgtaaccagatatggtaaactttttacaatttgagaaagtgtgggcgctctggaattgaaaagactccaagagtgccccttttttgagaataaaagagtattacgaagggataaggtgaacatatgaaagcgtttctaattttagaagacggaactgtgtttgaaggcacaagcatcggctcaacaaaagatatgattagtgagattgtattcaatacttcaatgactggatacttagaggtgctgacagacccttcttacgccggacaggccgttgtcatgacatatccgctgatcggaaactatggtattacaccggatatggagtccaagaaggcgtggccggatggttatattgtaagagaattgtccagaatgccaagcaacttccgttgtgaaggtacaattcaggatttcctgaaagaacagaatattccgggaattgcaggaattgataccagagcacttaccaaaatcctccgcgaaaagggtacaatgaatggtatgatcacaacgaatgaaaattacaatctggacgaggtacttccgaaacttcatgcatacaaagtaggagatgtagtttccaaagtaacttgcagtgaaaaatatgttttagaaggcaatggaccaaaagttgcattgatggactttggcgctaagaacaacattgcaaggtctttaaatgatcgtggatgtgaagttaccgtttacccggcaaatacacctgcagaagagatcatttccgcaaatccggacggtatcatgctgtcgaacggacctggcgatccggcggattgcacttccattattaaagaaatcagaaaattatacgactcagatatcccgatctttgcaatctgtctgggacatcagctgatggcactcgccaacggtggtaagacctataagttgaaatacggacacaggggcgggaaccatccggtaaaagatctgcagacaggaagagtttatatttcttcccagaaccatgggtatgctgtagatgctgatagtattccggaaagcgttgcagtacctgcatttgtgaacgtcaatgacaagacaaacgaaggaatgtcatacgttggaaagaatatttttacagtacagttccatccggaagcttgcccgggaccacaggattctggttacttgtttgacagatttatggatatgatgggaggaacaaaataatgccaagaaataaagacataaagaaagtattagttattggttccggtccaatcgtaatcggacaggcagcagaatttgactatgccggaacacaggcatgccgttcactgaaggaagaaggacttgaagttgtacttctgaattcgaatccggcaacgatcatgacagacaaagatattgcagaccgcgtttatatcgaaccacttacggtagaagttgtagaacagctgatccttaaagaaaaaccggacagcgtacttcctacccttggaggccaggccggactgaaccttgcaatggagctggaagaagcaggattccttaaggaacataatgtgagactgatcggtacaacggcggaaaccatcaagaaagcagaagaccgtctggaatttaaagataccatggaaaagatcggtgagccggttgcagcttcactggtcgttgaaaatatagaagatggtgtcgcgtttgcagataagatcggatatcctgttgttcttcgtccggcatataccctcggcggaagcggtggtggtatcgcacatgatcaggaacaattggaagaaatccttgagaacggactccgtctgtcacgtgtaggacaggttcttgtagaacgctgcattgcaggatggaaagaaatcgagtacgaagtaatgcgagatagtgctggaaactgtattactgtatgtaatatggaaaatattgatccggtcggagttcataccggtgacagtatcgttgttgcaccttcccagactcttggagataaagaatatcagatgctgcgtacttcggcactgaatatcattacagaactgaatattactggtggatgtaacgtacaatacgcattacatccagactcttttgaatattgtgtaattgaggtaaacccgcgtgtaagccgttcttctgcactggcttccaaagcgacaggatacccgatcgcaaaagttgctgcaaagattgcccttggatatacactggacgagatcaagaatgcagttacaaagaaaacttatgcaagcttcgagccaatgcttgactactgtgttgttaagatgccgagacttccgttcgataaatttatcagtgcaaagagaacgttgacgacacagatgaaagctaccggagaagttatgagtatttgcgataactttgaaggagctcttatgaaagcaatccgttctctggagcagcatgtagactgcctgctttcttatgatttctcagcactttccaaagaagaaattctggaaaaactggaaatcgtagatgaccgcagaatctggatgatcgcagaagcactccgcaaaggaatctcttatgacgagatccatgcgatcacaaagatcgacaaatggttcatcgacaagatcgcaatccttgttgagatggaacaggctctgaagacacaggaactcacaccggaacttctgaaagaagcaaaacgtattgaattcccggataatgttattgcacgactgaccggaaaagatgagagagaaatccacgatatgcgtcatgcaaacggaatcgttgcagcatacaagatggttgatacctgtgcggctgagttcgcggcagagaccccatattattattctgtattcggaagccagaacgaagtagaagagacttctggcaaaaagaaagttctagtacttggatcaggaccgatccgtatcggacagggtatcgagttcgacttctgttctgtacattgtacatgggcatttgcaaaagaaggatacgagactattatcgtaaataacaacccggaaactgtaagtaccgattttgatatcgcagataagctgtattttgaaccacttactccggaagatgtagagagcattgtagacctggaaaaaccggacggagcagttgttcagtttggtggacagactgcgatcaaattaacagaatccctgatgaagatgggagtgccgattcttggaacttccgcagaagatgtagatgccgcagaggacagagagctctttgacgagatccttgcacagtgcaatattccacgtccgaagggagatacagtatttaccgctgaagaagcaaaagaggttgccaaccgtctcggatatccggtactggttcgtccttcttatgtacttggcggacagggaatgcagattgcaatcaacgatcatgatattgatgaatttatcggaatcatcaaccgtattgcacaggatcacccgattctggttgataaatatttggtcggtaaagaaattgaggtcgatgcagtatgtgacggaacagacattctgatccctggtattatggaacatattgagcgtgccggaatccattctggtgacagtatttctgtatatcctgcgcagagcatttctgaagtgacaaagcgtaaaattgaagaatatacaaagcgtcttgcaaaagcccttcacgtaattggtatgatcaacatccagttcatcgtatgtggcgaagatgtttatgtcatcgaagtaaacccacgttcaagtcgtaccgttccttatatcagtaaggtaacaggtatcccgatcgttccgcttgctacaagagcgatcatcggacataagatcagagaaatgggttacacaccgggacttcagaaagaagctgattatattgcaatcaagatgccggtattctcatttgagaagatccgtggtgcagatatcagccttggaccggagatgaagtctacaggtgagtgtctgggaattgcaactacatttaacgaggcactttacaaagcgttccttggagctggaatcaaccttccaaaatataagaacatgatcatgactgttcgtgatgaggataagggagaagctgtcgagatcggacgcagatttgaggcacttggctaccgcatctttgcaacacgcggtacagctgatgcattaaaagaaggtggcgtaaaagcaattccggtcaataagattgagcaggaatcaccgaacctgatggatctgatccttggacacgagatcgaccttgtaattgatactcctccacagggagcagatcatgcacgagatggatttgtaatccgtcgtaatgcaatcgagacaggtgtcaatgtactgacagctatggatacggcaagagcacttgtgacaagtctggaaaatacagatatccgtcagcttacactgattgatattgcgaaagttgaataagatgttatgaatacggacaggcagggattggattctctgcctgtttgtgttatggaaaatgcagggacgagacggacgctacagtggcaaaagaatgtgaagctgtgtagaggatttcggatattggctggaattgcggggaaggagttttatagtgtgaaaactattgtatgtgtggataaccggatggggatatgttttaatggcaggagagtgagccgggaccggatggtgccagaggatattcttgagatgacgagagggaatgtgctctggatggcgccggaggcagataagctttttaaagaagtctttaaagcaaaagaagaggtatgccgggaaattgggactgggaagaaaatacaggacgcagggcgactggaggatgaaaaaatgtggaaggttgaccggaattttctggaaaaggcagaagaagaggatttctgttttgttgagggggagaatctggctggatatgaggggaagattacagagattgttctgtataaatggaaccgggattatccggcagatgtattttttgaggtagatttaagcaagtggagactggaagagagaaaagatttttccggttactcccatgagaagattacaaaagaaatttacaacaggcagggattgctatgaagaagaaaattgggaaaatgagaggtgtgctgcttctgacgtttgcattgtttctgacagcgtgtggcacaggtggagcagatgcgcaaagtgcatcatatggaaacagtcaggcagcagtagttgaaaggcagtcgggtagcggagaaaatgaatcgacagcaggtggcagccaggatccggtgagcgctacattggataatattccggcatacagcggaacaccgtatgtagtgattgacgataatgaaccggattttaccgaagatgagctgacagatcagtcttatgaaagctacagtgatctggatgagctgggacgatgcggcgttgccgcgtccaacattgggacagatctgatgccgaccgggaaaagaggaaagattggacaggtgaaaccgtccgggtggcagacaataaaatttgacaatgtggatggaaaatatctttacaaccgttgtcatctgataggctatcagctgacggcagaaaatgcaaacgaaaagaatctgattacaggaacccgctatatgaatgtggatgggatgctgccatttgaaaatatggttgccgactacatcaaagagacagataatcatgtaatgtatcgtgtcacaccggtatttgaaggggagaatctggttgcatccggagttttaatggaagcagaatccgtggaggatcatggagaaggtgtgaaatttaatgtgtatgtctataatgtacagccgggaattacgattgattatgcaacgggaaaggcagtgctttccgatacggatgcgtcagtggatacgggaaaaaccagtggaaatacagagaaaaagatgtatgtgttgaatgaaaatacaaagaagttccatacgccggagtgctcaggagtaaaagatatcaaagaaggaaataaaaaaacatttacaggttcaagagaagaactgattaaagaggggtatatcccgtgtgggagatgtaaaccgtaagaggaaaataaaagaaaaactgcatattctgcgaaaaatataaaacaaacgggagatttttaaacaaaatctcccgttttctgctataatagaaaacatacttaatgaatatacattagaggaaatgtgtaaaagaaaaaggaggaactttctcatgaatacttatcatatgggaacaaaatgcgtgcagggaggatatacacctggaaatggagagccgagacaggttccgatcattcagtctacgacattcaaatacaatacaagtgaagatatgggaaaattatttgatctggaggcatccggatatttctacacccgtctgcagaatccgactaatgaccacgtagcggcaaagatcgcggcgatggaaggcggaacagctgcaatgttgacttcttccggacaggcagcgaatttctttgctatgttcaatatctgtgaagcaggagatcatattgtggcttcctcttcgatttatggtggaaccttcaatctgatcagtgtgacaatgaagaaaatgggaattgacgcaacatttgtttctccggatgcaacagaagaagaattaaatgcggcattccagccaaatacaaagctgatgtttggtgagacgattgccaatccggcacttactgttctggatattgagctttttgcaaaggttgcgcatgcgcatagtgtaccgctgatcgtggataataccttcccgacaccggtcaactgtcgtccgatcgaatggggagcagatattgtgacacattcgactacaaaatatatggatggacatggagcagcagtcggtggagcaatcgtagacagtggtaaatttgactggatggctcatgcagataaatatcccggactttgcacaccggatgaaagctatcatggaattacctatgctgagaaattcggaaaagaaggcgcatttatcacaaaatgtacttctcagttgatgcgtgatctcggatcgatccaggcaccacagaatgcatttatcctgaatctcggactggaatctcttcatgtgcgtatgccaagacatgtggagaacggacaggctgtcgcagaatttctggagcagcacccaaaggttgcttatgtcaattatccgggacttccatctaacaaatactatgaaagagcaaagaaatacatgccagacgggggctgtggagtggtatctttcggattgaaaggtggaagagaagctgcttccgtattcatgcagaatctgaagcttggagcgattgaaacccatgtggcagatgccagaacctgttgcctgaacccggcaacatccacacatcgccagatgaatgatgagcagttaaaagaagcaggagttccggcagaactgattcgcatcagtctgggacttgaagataaagaggatctgatcgcagatatttctgcggcacttgacgcaattcaataatcgtgtcacaatgacagataaagaaatctgatcagacaggaggaaaagagtcatgacaaagaaatcagaaagacaaccaatcaaagcagaaaatgtagcgggtggcgcaggctatatcctgaaggaagaactgatcaaaggtgaacagctcggcgcgtactgcaagatgttcaatgaagtaacgttaaaacctggatgtgagatcggatatcatgagcatcatggagagactgagacttactatctgacaaaaggggaaggcatttacaatgataatggcaaagaatatccggtggaagttggtgatgtgactttctgcgcagacggaaatggacatggcatcaagaatgcggggaaagaagatcttgtgtttgtggcgcttattttgaaagaatagtgtgaagagggacggatcccggcgcaaatgatattgatcgtcacctatgaaactgtcactggcagtttcatacggatgcatggcaactccgaagcttgtacaaaaaaggggatgatgttcgtgtgaacacggacaccacccctatttttttgcgctcttagccgcaacgattcaatatcatttgcgccgggatcctgtgctgctcaaaatttttagaaataagagttggcgatttagtgaatggtcttcttgtggggataggaaacattatgcaaagaaatcctgtattccttgaagcagtctcttattatcttccggagccataatgcagaaccggaagtattccccgcccagttctttgaagctggagcagtctctcaccatcagaccctgcttgatcagaaattcaaacacatccgcagaagtaactccctctttttcaatctttaccagtacaaaattcgcataagcaggatacacagtcagcacattgattttggagatttcagtgcacattttgtctcgctcggagaggatcagatcccgtgttttccggatatactcctgatcctggagcattttctcaccagcgtaagcgccgaggctgttcagactccatgggttctgcatcagcagaagatcctgaagaaactggctgttactggttgcaccgtagccgaggcggagaccaggtgcggcataaaatttggatacgccacggagaatcatcagattatcaaaactgctgatcagagacatggaagaaatttcattaatatccggtgcaaattcaacgtaagtctcatcgatcatcaagaaagagccagcctcccggcagcagtccagaatggtctggatctcaggcattttgagagcggacgaagtcggattgttcgggttacataatatcaccagatcatagcccttcctgatttcttcgcagaaggcatggatatcaagatggaacagatctgactcttttaacaggtaagtatggatggaacttcccaccagatccagttcacgtccatactcggaataagttggtccaagaaccagcgttttttgtggtttccgtgtctggatcagaagagagatcagctcggtagaaccatttccgacgattacatgttccggtaaaatctggcagtaatcggcaatcactttcttcaaagtagtgtaatttcggtccggataactactgagaagatccagatgtgcagcaagatcttttttcaggtttttggataatccaagtgggttgacattggctccaaagcagatgatctcgtccaccggtacatgataaaatgcggcgacagcagcggtgtcacttccatgaaactgcggttttgcttccataaatagtattctcctttgtgtataacaaaaatctgtgaattaaaaaaatcgggtattccgcattgcctgatatgcagaataatgttataatttattataatgtctttttgaaaaaatgcaatgcagaagtaggtggcaagcttgaagaataaaataaaaaaattttccaaaggagattttcgaactgttcatccggagattgtactgccggtaacgaatcttgagatgacgatcggggaaggagagtcctgccagggaagtttcattttgaagaacaggaaagaaggagatatcagaggacttgtatattcttcttcttttcgtatacatttagaagaacagggatttgagggcaacccggtggaactccgttttacttatgatggaagcggacttgctcccgggcatgttgaacagggaaagtttacgattgtatgtaatggtggagaatttgaggtaaactttactgcgatcattgaaaaaccatcagtcgagacttcctgtggaagagtacagaatatccgtgattttaaaaggctggcgatggagaactttatcgaggcacaccgtcttttcagatcacgcgatttttatgacgtgataaagtatgaagagccaaggataaaggcactttatgataatattaggaaatggtctctcggtgagcaggcgatggaagaatttctggtcggaatcaaacagaaagaatgtattttcctgacaatgggacggaatcagagaactttccgcaatttaaaagaagcaacccgtgagattattcattttacaaagaatacttggggatttatgccggtgaaggtgcatgtgagcggtgattttatccagattggaagggataactttacaacggacgattttgtgggaaatctgtttgatttcagttatatcattcatccggaaaaggctcatgcgggaaataattatggacagattgtttttgaaagtccgtatgaatcgctgacctatgaggtaatgttggccaatcacaaggatcatgcagagaacagacgtgtggcagataagacgattgcatcaatcataaaggatttccttgcgtgtaatgcggaaggaaaggatctgacagcctgggcggacgcaacaagagaaaaactgaagggactggatatatattcagaagacggagatgtttatccactgtttgatgcacatcttaacctgctctgtaaggagccggacaaggccagtggtattctggatgattacaattacagccgtttctcagtgaataaggattcggtcatttcatcgtattatctgtatctgactgcgcttttgagaaaatcaggcagccaggttaacaaagcaattgaagaactgaataaggcatatatgaaagaaccaacttcatgggagcttgtgtgtatgctgattgacattgatccggaatataaaaactacagcaaaaaattacaggttctggaacgccactgcagcaacggtgcgaaccaggtaattctgtactggcaggcataccggtgttttctggagaagccaacctgtctgaaaaagctctcggcatttgaagtacagattctcaattttgcgcagaagcacggagttctgacaaaggaaattgcgctttatatggcgaaccttgcatcccaacagcggacttatgataagaatctggatgttgtgatgcagaaggtttatcggattttcccggatccacagattctgacagcaatttgtacccatctgatccgtggcaatcggacaacaccggaatgctttaagtggtatgccttggcagtaaaagaagatctgaagattgcgcagctttttgaatattatatgatgactgtggatgacaaatatctggacagacagtttccaaaatccgtattactttacttccggcatggaaacacactggaatataaaaaagcagcggtgttgtatgcaaatctgattaactgtgaggaagaaagcagtgagctttacagtgcttacagagagcagatggagcggtttgcctggatgcagcttgagaatcgaaggatcaatgatattctgcatattatttacaaacgctgctgtactgagcgggatatgacaccggaaagaatccgagcagtttatgatatctgccatgcttatgagattaagacaacggtaaagaacatggcgtttgtcatggtaatcgagcctgacggaacgatcagtcagaaagtacagtacagtgcggatggagtgattgtatatttatacaataaagacgcacggattgtctgggaatcaaaagacggccgccattacattgattccattccatatgagactatgaggatgttctatgagaaccggtatatggaaatctgcaaaaaatatcaggaagagcatgaggaagaggaacgaaagaaagagaaaaaagaactgacctgggatatgcttagagagcacgggctggagatggcagatgaaaaagaagtgtttaaaatgtgcagtatgcgcctgcgtgaagaaggtacggaggaggatgattttcttctggcattatgctttgaactgtttctgaaagatcagtatgataagcagacgctgtcttatcttgctgagtattattgtggatcgacccgtaatatgaagaaactctggcatgtggcaagagattatgatattacaacctacaagctttcagaaagaatcattacgcagatgcttttctcggaaactatgtttggtgaggaagaaatttttgcggattattatgaaggaagaacgtatttccgtttaaagagagcatatcttgcttatgtttcaagagaatatgtggtgaacggacgccaggtaaaaggatgtatttttgtaatcatcgcaaatgaataccgcaaagaggaagatcttccggatatctgtaagatcgccctgctaaaatattattccagcagggaagtgcatcaggaactggaaccgatgctacgggaattcctgcgcgaaatgtgtgaaaaacagctgtatttttctttctatttgaagtatccggagaactggctcagagaagtgcagctttatgataagacgatgatcgaatatcacgcaaaacctggaagcaaagtggcaatttcctaccagatacggaaaggcgaaagtgataatatgaattatcaggaagaaatactgcttccggcatatgaagacacttatatcaagagctttattttgtttggtgatgaatctctgcgttattattttacagagacgaataaggataaggtgacggttacggaaaaaagtgactataagccgcgtgaggtgagaccaatcggaaaatttggaagactgaatgatatgacatcactgaagaatgaagcactggcaatcgcgatgaaggaatttgcaacagaaaaacagcttgctgaggatatttttgttgcttactaaaggaggaaatacttcatgacacatggaagtattataggatatgacatcaatgcaaagatgtgtcagatcagttattataatgaaaaaacacaggaaccggagacggtggataccggaattgaaaaagagaacaatcagattcctctggtgatgaactattataaagagacctggacttacggaagacaggcaagaaggatgtctacggtaagggacagtatctgcgtggaagggatctgggagtgtgcgcttggcaataggaaaattgaggtagacggacaggaatatgaaggcgtccagctgctggcggattttgtaaagtacacgttgaacggatttgaagaaattgaaagcatcacgtttacagtcccggagaaaaacgaagacatccgcgtcttgctgaagggaatcggacagaaactcggagtggcaaaggaaaatatttatgttcaggactacaaggaaagcttctgtcattatatgtttaaccagccgaaagaattatggcagtatgaagcggcacttttttactgtgacgaggatgtgatccgggcatatatgttgcgggaactgaagaacagttcgcagaaaagcagagaaagctttgtgacggtggacaaggtggcagatgcacgtatggaagaactggaagcagtttatccggtgctgcatgttgagaaggcaaaagcggcagatgagcattttaaacgttttatccagagtgtattcaacaagaagatgatctcttctgtctttttgacaggagatggatttgaaaataactggtatccgaattctctgcgcgttctctgtaacggacgccgtgcgtttatgggaaataatctgtacagtaaaggagcgtgttatacagcgcagcgcagaaaagaggaacagtcagatgcaccagtctacctggatgagacaaaactgaccgagcagatttccgtgcggatgcgcgtgaatggagaagaaggctggtacccactggtatcctggggcaatcactggtacgaatcagacagacagttcgaggtgcttcttggtgatacagaggatattgagatccatgtagattctctggtgaccggcaggcatcttgtggagtcggtttctctgaaaggtatgccggaccggaaaaactatgcgcttcgtctgaaaattagtacattcttctcggatgaaaagacctgtcatattatttttgaagatatgggatttggcgaattttttgcgccatcaggattccggttggagaagatcattgaattaggaggcagcaatgggcagtttaattctttgtcataagaaaaaggcaaaacatccctatgaaatttcgaggatccatacaaggatcagtacactggaagagctgtgttattatctgtgcaacaatctgtatctgatcgattatacgatcatgaatgagcagctctgcagatggatcgcagatgaactggaaatgcaggatcttgcagtaaagctggtggaactgatccgaaatcatggttccgtggagaaatttgtggttcttgtgctacatgaatccagaatctacacaccgggtgaaatggcacacatccagaatgttctggagaaactcaagaaccagaaagaagtagaacgtcagaaatacaaagcagataagctgatggaaagtggagaactggaatcggcaatcctggtttacatgtcgatcgtcaacggagaaaaggatgattcggtagataagcgtttttatggtcgcgtgtcagcgtgtcttgccggagcatatgggagagcatttctgtatgaagagtcggcgagaatgtatgagaaggcgtataagatctgtgaagataataaaatgctcgaaggttacctgtatgcaagttccagatacatgccgcaggatgaatatcagaagatggtcatgggcaatgaaatccttttggaaattgacaacaaacttacagaaaagatagaaaaagtgagagaaaatatcaacatcgaaccgtcaaaggaactgtttgaagaatggaaaaaagagtacagaagagcatagtgtacgggagaaagttcaaggctgtgtattgattttcggaaaatcatgtattatactctctatgtaaaaattaagcggatacaacaaataggagaagacaaaacgatgagcgaacttgaaagagtagagactggtttaggtgaagaatgtggtgtattcggtgcctatgatatggatggtggcgatgttgcgccgtcagtgtactatggtttgtttgcccttcagcacagagggcaggaaagctgcggaattgcagtgacagatacctatggcaagcggaaagttcatttcagaaagggactaggactagtcaatgaagtattcgatgaggaagaacttggaaaattaaagggaaaccttggcgtcggacatgtgcggtattcgacagcagggggaactcgtgcggaaaatgcacagccactggttctgaattatgtgaaaggtacattggtgattgcccataatggtaatctgacgaatgcgatcgagcttcgtcatgaattggaatataccggagcaatcttccagacaacgattgattcggaagtgattgcctatcatattgcaagagagcgtctgaaggtttcaaaggcagaggatgcggtcaggaatgcaatgaagaaaattgaaggcgcatatgcactggttgtatcaagcccgcgtaagatgatcggagcgagagatccatttggtctcaaaccactctgtatcggcaagcgagataatacctggttcctggcatcggaaagctgtgcccttgcagcagttggtgcagactttatccgtgacgtggaaccgggagagattgtcagctttacaaagcatggagtatcttcggacaaaagtatgcagattccacttgaaaagcaggcacgttgtatttttgagtacatttattttgcacgtatggacagcgtaatcgacaacatcaatgtatatcatgcaaggattgttgcaggaaaggctcttgcacagtcttatccggtagaggctgatctggttgtcggtgtgccggattccggactggttgcggcaaaaggatattcggaatattccggaatcccttacggtatggcattccacaagaacagttatgtaggaagaacctttatcaagccgaaacagagtcagagagagtccagtgtgaagatcaaactgaatgttattgaagaggttgtacggggcaagcgtattgttatggtagatgattccatcgtccgtggaacgacctgtgcaaatatcatcaagatgctcaaaaaagcaggagcaaaagaagttcatgtaagaatcagttcgccaccgtttttacatccttgttattttggtacagatgtaccgtcgaatgatcagctcattgctcattcacatacaacggagcagatccgtgaaatgatcggagcagattctcttggatatatggaaatagataagctgaaagacatggttggagatcttggatactgcgatgcatgttttacaggaaattacccgatgcgcgttccgggaaaagatatttcccacgcgtttgagtcagaagaatagggaggataagactatgggatacgacaagtatgtaagtccgctttcagagcggtatgccagcaaggagatgcagtatattttttctccggacatgaaatttaagacatggagaaaactctggatcgcacttgcagagacagaaaaagagctggggctcaatattacagatgaacagatcgcagaactgaaagagcatgcagaggatatcaattacgatgtcgcaaaagcgcgtgaaaaagtagtgcgccatgatgtgatgtctcatgtatatgcatatggacagcagtgcccgaaagcaaaagggatcattcatctgggagcaacttcctgttatgtaggtgataataccgatatcattatcatggcagaggctctgaaacttgttaagaaaaagctggttaatgttctggatgaactttcaaagttcgcagatcggtataaagatcttccgacacttgcatttactcatttccagccagcacagccgacaacggttggaaagagagcaactctgtggatgcaggaattttctatggatcttgcagatcttgattatgtgcttggaagcctgaaacttcttggatcaaaaggaacaaccggtacacaggcaagcttcctggaactgtttgagggagatcaggagaccattgataagatcgatccaatgattgctaagaagatgggatttgaagcatgctatccggtatccggacagacctattcccgtaaagtggatacaagagttgtgaatgttcttgccggaattgcagcaagtgcacacaaattctccaatgacatccgtcttctccagcatctgaaagaagtggaagagccgtttgaaaagacacagatcggatcttctgcaatggcatataagagaaatccaatgagaagcgaacgaatcgcatctctgtcccgttacgtgatgattgatgcactgaacccggcgatcacttctgctacacagtggtttgaacgtactctggatgactctgcgaacaagcgcctgagtgtaccggaaggttttcttgcgattgacggtattctggatctgtgcctgaatgtcgttgacggactggttgtatatccaaaagtaattgaaaaacgtctgatgtctgaacttccgttcatggcaacagagaatattatgatggatgcagtaaaagctggtggagaccgtcaggaactgcatgaaagaatccgtgaactttcgatggaagcaggaaagaatgttaaagaaaaaggtctggacaacaaccttcttgaactgatcgcgtcagatgatgcatttaatctgagtctggaagatcttcagaaaacaatggatccatccaaatatgtaggacgttccaaagaacaggtcgaagcattccttaagaatgtgatccggccgatcctggatgaaaataaagagctgcttggtgtaaaagcagagatcaatgtatagaataactgaataaacagaatggaagagcaggaagcagatttccgggtaagacggaagattgctccctgctttttatttatgtttcatggtctgaaaataacttctttgaaatatcaatatagtaaagaattaatgcgttcatctgaaagaatctataaatcccatggaaatgcatagatattaaatcgtcattaattagacaatttgacgaaaaatatgaaaactgagtttttgacaaacacagaaaagcgcgaaaaaacgcacttatttagagcaaatttattatgttatcgtaataacatggtgataatacacaaaaaataaataagttaactgaaaatattgcataaaaactataaataggttattatagattcaacagataaaaactataagggatgtctattaaaaaggagggttaccgtatgagtattaacgatttagtattaaaggtaaatgatgtcctaacaggatcggtgctgatcatagcacttgtaggtattggcttgctgttcacatttaagcttggatttattcagatccgtggttttaaagatggatggaacagaacttttggcggactttttagcaagaaaggggatgccggaaaagacggaatgtcttctttccaagcacttgcaacagcgattgctgctcaggttggtaccggtaatatcgccggagctgcaactgcaattgcagtcggtggtccgggagcaatcttctggatgtggatcagcgcattcctcggaatgtcaacgatcttcgcagaagcggttatggctcagaagttcaagcaggtcagtgatgacggaaccgtaaccggtggtccggtatattacattcgaggagcatttaaaggaacgttcggaaaagttctggcagctatttttgcagtcctgattatctttgcacttggattcatgggcaatgcagttcagtctaactcaatcgcagcatcatggaacactgcattcggaattccgaagattgcaatgggtatttttgtagcagttgtttctctgtttgtattcacaggtggtatgaagcgaatcgcaaaagttactgaactgatcgtgccgatcatggcagcattttatatagtaggttctttgatcgtaatttttgcaaacgttacagcaatcccggcagcattccatgacattattgtcggtgcgtttaaaccggcagcagtagcaggtggtgcaatgggcgcaaccttgaagcttgcagtacagaaaggtgtggcaagaggtctcttctccaatgaagctggtatgggttctacaccacacgcacatgcagtagcaaaagtaaaacatccggttgaacagggctttgtagctatgatcggtgtgttcattgatacattcgtaattcttaacctgacagcacttgttattatcacaaccggttcaagaacgactggtcttacaggtgcacagctgagccagtatgctttctctacattatatggtaagttcggtgagatctttatcgcgatctgtatgttattcttcgcattctcaacgatcatcggatggtatttcttcggtgaagcaaacatccgttacctgtttggagcaaaagctgttaaaatttactcaatcattgtatgtatctgcgtagcacttggatcacttcaggaagtagaacttgtatggaatatggcagactgctttaacagtatgatggttatcccgaatgcgattgcactggtagcactcagtggtcttgttaagaagacgcatgacgattactataataatttcctgccaaatcagaaaaaaggcaaatagataatttgtataataactgaaaaatagttatagaaaaaaacaataagaaatatacaaaaaaatctataaaaagactagcattttgcataaatgtgtgctatagtaatcatgtcagcaagaaagatgctgtaaaatgtataaaaaatgcagtcaattagatagtaggttgatatttcctgcgagagaatcatttataaagatatttgataaatggtcgccgaagatgcaaaccgtagagcagtaaagctcgttgaatggtgaaactttcaggcaaaaggatcgggaaaggtactacactctgaatccggaattgccgaatttacaaggagacagaaaggacgtttaaaacagagaagttgttttggcgtccttttttgataccagatatatgttaaaaaaatatctggagtatttcagacacagggagccaaaaaagaccgcataaacggacaggggacgaaaggaagaagcggctatgaatactggatttatgattatcacaaataatccactggtaaaagaaaaactgggggaagattatcatgtggaatacgaagaactttcttatgaggacacacttaaaaaagttcagaagatgatcttccagggataccggcttttgacacatccgctgtccggaagcgtaaaaccgaatgagactccatataagtcggttatgctctcagaaacgccggaaggtctggatgcacaggcgatgcagatcattgcaagcgccattcaggcgtgcggtaaatttcagtttaagtctgatctttataaacctcaggtttatgcagactttcagcttgtagattacacattgatctcaagcgctctgccgtcagcggaaagctggcgctaaaaaaaggctgtagaagtacatgcggtttagtgtacttttgagcatacaacaaacacattcaaaaaaggagggaatttacagtgaaattagaagtaggtcacatttttattaacgacattcagttcgcatctgaatcaaagatcgaaaatggtgttctgtatgttgacgaagaagctgtaaaggcaatcgttcttgaggacgaaaaaatcaaagatgttaaatttgatatcgcaaaaccaggtgaaagcgttcgtatcactccggttaaagatgttattgaaccacgtgttaaagttgaaggaagagggggagtcttcccaggcgttatcgcaaaagttgacactgtaggtagtggtaagacatatgcattaaaaggaatggctgttgtaacagctggtaagatcgtgggattccaggaaggtatcattgatatgtctggcccgggtgcagaatatacaccattctctaaacttaacaacttagtagttgtttgcgaaccagttgaaggaatcaaacagcatgaatatgaaaaagctgttcgtcttgctggattcagagtagcagtttaccttggagaacttgctcgtgaactcacaccagacgagacaaagacatatgagacatacggaatcatggaaggaaaagaaaaattcccgaaccttccgagagttgcttatgtacagatgcttcagagccagggacttctccatgacacatatgtatacggtgttgatgctaagagaacactctctacaatcatgaacccgacagaagttatggacggagctatcgtatctggtaactgtgtatccgcttgcgataagaacccaacatatgttcatgaaaacaacccggttgtacatgacctgttcgaagaacacggaaaaacaatcaacttcgtttgtcagattcttacaaacgaaaacgtataccttgctgataagatgcgttcatctgactggacagctaagatgtgccgtctgttagaccttgatgcagttatcgtatctcaggaaggattcggtaacccggatactgaccttatcatgaactgcaagaagatcgaagctgaaggcgttaagactgtaatcattacagacgaatatgccggacgtgacggaaaatctcagtcactggcagatgctgatccggctgcagacgcagttgtaaccggtggaaatgctaaccaggtaatcgtacttcctaagatggataaagtaatcggaacagaagattttgttacaaccattgctggtggtaatgaacattctcgtcgtgaagatggaacaatcgaagttgaaattcaggccattaccggtgctacaaatgaaaccggatttggatatctgagtgcacgctaggaatggaggacgtaaagataatgagtaaaattaaagttgtacattatatcaatcagttcttcgctcagattggtggagaagaaaaagctgattatcctgctgaacttcgcgtaggcgaaatcgttggacctggacaggctctgacacagcagtttggagaagaagcagagatcgtagctacaatcgtttgcggtgactcttacttcaatgaaaaccttgacaaagcaaaagctgatattcttgaaatggttaagagccagaatcctgatatcttcatcgctggacctgctttcaatgctggacgttacggtgttgcatgcggaactatctgtgatgcagtacaggaagaactcggaatcccggcagtaactggtatgtacgttgaaaacccaggtgctgatatgttcaagaacaaagtttacacagtatctacaaagaacagtgcagctggtatgagagacgcagttaagaaacttgctcctcttgctcttaagatcgctaaaggcgaaaaaatcggtgcttcttgccaggaaggttacatgccgaacggagttcgtgtaaacttcttcgaaaaagaacgtggatctaagagagctgttaagatgctccttaagaaactggcagacaagccgtttgagacagagtatccaatgccaacattcgaccgtgttgatccacagccagctatcaaagatcttagcaaggctacaatcgcactttgtacttcaggtggaatcgttccgaaaggaaatccggaccacatcgaaagttcaaatgcctcacattacggagaatatgacatcacaggtgttatggatcttacagaagagacatacgaaacagctcatggtggatatgacccggtatatgcaaacgaagatccagaccgtgtacttcctgtagacgttatgcgtgaattcgaaaaagaaggcgttatcggaaaacttcacaacaaattctatacaacggttggtaacggtacagccgtagcttctgcaaaagctttcgctgaggaatatgctcagaaacttatagcagacggtgttgacgcagttatcatgacctctacttgaggtacctgtacacgttgcggtgcaacaatggtaaaagcaattgaagcagctggactcccggtagttcatatgtgtacagtaactccgatttccatgacagttggtgcgaacagaatcgttcctacgattgctattcctcatccacttggaaatccggctcttgaaaaagatgaagagtatgctcttcgtaagggtcttgttgaaaaagctctgaaagctcttacaacagaagtagacggacagacaatctttgacaactaaatcatagttagaaggtcatgtaattttattaaaaaaggagagaacgttatgagcaaagtttatgacgtgatcgtcctgggtgcgggacctgcaggcttagctgcaggtctgtacgcaggaagaagccgtctttcaacactggttattgagaaaggtaaagatggcggacagatcgcaatcacagatgacatcgaaaattatcctggacagatcgtagaaggggaaagcggtccttctcttatcgcaagaatgacacagcagtgtgaaaaattcggcgttgagagagcctcagatgtaattaacgaagtacacctggacggcgatatcaaagtactgaagagtgcgaaggctgaatatcagtcaaagacggttatcatcgcaaccggagcttttgcaagaccgatcggatgcaaaggcgaaaaagagttcatgggcaagggcgtttcttactgcgctacctgtgatgcaaacttctttgaagattttgaagtatacgtagtaggtggaggagactctgctgtagaagaagctatgtaccttacaaaatttgcaagaaaagttaccattattcacagacgtgatgagcttcgtgcagcaaaatccatccaggaaaaagctttcaagaacgaaaaacttcactttatgtgggatacggttgtagaagaagttggcggtgacggaatcctttctgagatgactgttaaaaatgtgaaaacaggtgaactcactaagatcgtagctgatgaagatgacggaatgtttggtgtattcggatttatcggaacacttccaaactcaaagatctatgaaggaacaggccttgagatggatgaaagaggatatattccgacagatgcagatatgcacactaatatcccaggcgtattcgcagcaggcgatatccgcgttaagagcttaagacaggttgttacagctgcagctgatggagcaatcgcagctacacaggcagaaaagtatattaacgaattaaaataataaacactttttaatagagtgaggaggacatttgacatgttagaagtagataagaaaacattcgaagacgaagtcttaaaagcagaaggttatgtattcgtagatttctttggtgatggatgtgttccgtgccaggctctgatgccgttcgtacacgaaatggcagataaatacggagataagatcaaattcacatctctgaatacaacaaaagctcgtcgtcttgctatcggacagaagatccttggacttccggttatggctatttacaaagatggcgaaaaagttgaagaagtagtaaaagacgatgctacacaggaaagcatcgaagcaatgattaagaaatatatctaatcattatttaattaggtgagccgcgcacagccggcagagatccggctgtgtgctcacaatatataatcgcgtaaagcgtgtaaaactattatcaaaacaaaattttaaaagaaaggaaggaggaaaagacatcatggcaattttaaaagataaaaaagttgttattatcggtgaccgtgacggtgtaccgggaccagcaatcgcagaatgcgttaagacagctggcggagatgtagttttttcttcaacagaatgtttcgtctgaactagcgcaggcgcaatggatctggagaatcagaaaagggtaaaagaatttgctgaggagtacggcccggaaaacgtagtcgtaatcgtaggcgcagctgaaggagaagcagcaggacttgctgcagaaaccgttacagcaggagacccgacattcgcaggtccgttgacaggggtccagcttggactcacaacttatcacgtatgtgaaccagagttaaaaaaagaatttgacccggctgtttacgatgaacaggtaggcatgatggaaatggtccttgatgttgatgatatcgtagacgaaatgtcagcaatccgcaacgaatattgcaaatacctctaagataaagagggatttatccttcgaagcggaatatctgagatagaggtacaggcggcaggattcttcctgtcgcctgttttattgccaggcatatcgggaacatgctggtattgcattagtgaattgcctagcatctcggaagcgtgccagtgatgcgcttctgataaaagcttgtttagcgcattctgcccaaaatcttttaaatcaggacaggtagattatacgcgcatatcacggagaaatgaatgatggtgacactcgtaaaaagagaatgtcaggaaaggtggaaaccagcgatgaacagtgtaattaaaggagcaggatatgtactcgtacataccccggaaatggtagtttacaacggaacaacacagacaacagaaagagttgttaatccggaatcagaatatttaaaagaacttagagatcatcttcggtcatatgatacatgtgtaaattattggccgaatcaggtatatatcggaaatgcaacaccggacgaccttgcccaggttgaatttccttactacgataaagtaaaagaaggtgcagagcgttacggaaaatacggtgagatcatgccggaagacgaattccttcttttagctcaggcatgcgacatgttcgaagttgttatgcttgaaaaaggatttgtagcagctacaaaagaaaaatttgcagcagatccgatcatcacagatgatatcgtagaaaaagtaatcgagggatttgaaatctcagaaatcgaacactttgtaaatgaagagcatgctgaaggtctgtatcatgaaaacaaactggtaggctgtgtaaagagagcgcatgacattgatgcaaacctttcagcacatgttatgcatgaaaacattatgagtaaggcatccagtgtgctcgccctcctctatggtgtaagaaacgcaggaatcgaaaagacagacgttgagtatgtcattgactgtgcagaagaagcttgtggtgatatgaaccagcgtggcggtggtaacttcgcaaaagcagcagctgaagttgcaggacttttgaacgcaacaggttctgactcacgtggattctgtgccggaccatctcacgcactgatcgaagcagcagctctcgtaaaatcaggcgcatacaaatgtgtagctgtaacagctggtggttgtacagcaaaacttggtatgaacggtaaagaccatgtaaagaaaggtcttccgatcctggaagactgccttggcggattctgtgtaatcatcgcagaaaacgatggtgtaaacccggaaatcaacctggatatccttggacgccatacagtaggaacaggaagtgctccgcagaacgtaatcggaagccttgtagctgatccactggaaagagcaggacttaagatcacagatatcgataaattctctccggaaatgcagaacccggatatcacaaaaccggcaggagccggagatgtaccgcttgctaactacaagatgatcgcagctctcgcagttaagagaggcgaacttgacagaaaagaacttgcaagcttcgcaggagaacacggactgacaggatgggctccgactcagggacatattccttcaggtgtaccgtacatcggatttgcaagagaagatatccttgctggaaagatcaataaagtcatgatcatcggaaaaggaagtctgttccttggacgtatgaccaacctcttcgatggtgtatctttcgtaatccaggcaaataccggtgcagaagataacagtggtgtatcagaagaagaagtaaaaggactgattgcaaaagcaatgaaagattttgcagcatcactcatggcaacagaagaataagaaaggtggacaaacaaaatggcaaatagtattgaaagaatgattgccgacacctttatggagatggcgcagggactggagacaggaagcttcggaaagcgcccgaaagttgcactgaccggaatgggaagcgaacatggagaagaaaactctatggcagcggcaattgaagcggcaaaagacggaattgatgtatattatatcggaacattagaagcagaaggcgttacaactgttaaagtggctaacgatgaagaaggtcatgataagatggaagaaatgctgaagaatggagaagtagatgcagcagtaaccatgcacttcccattcccgatcggtgtatctacagtaggacgctgtgtaacaccggcaactgcaaaagaaatgttcatcgctaatacaacaggaacatccagcacagaccgtattgaaggaatgatcaaaaatgcgatctacggaatcatcgctgcaaaagcttgtggcaagaagaatccgaccgttggtatcctgaatgtagacggtgcacgtcagacagagaaagctctgaagaaactgcaggagaacgggtatccgatcgaatttgcagaatcaggaagagcagatggcggatgcgttatgagaggaaatgacgtccttcaggcatccccggacatcatggtaacagattccctcacaggaaatatcatggtgaaaatgctttcttctttcacaacaggcggaagctttgaagctacaggatttggatatggaccaggaatcggagaaggatatgaacagcttgtcatgatcgtatccagagcatccggagcaccggttatcgcaaatgcaatccgttacgcagcacagctggtaagaggaaaagtatttgaagtagcgaaagaagaatttgcagctgttaagaaagctggattaaaagaaatccttgatgagcacaaagcttctcagaaaccggcagcggctgaagaagaagtaaaagagccaccgaaggaagtcgttacagcacagattccaggtattgaagttatggatctggaagacgcagttaaagtactgtggaaactcggtatttacgcagaaagcggaatgggatgcaccggaccaatcatccgtgtatcagacgcaaacctcgcaaaagctgaggaagaactgaaaaagagcggatatattaactaataaaatctgcctttttataaacactctcactctaattcaggaagatgggctttccggtcataagaccgggaagcctttttccttgcgaaaaactgtttttgcagaaagattatacattatttgtcacagatactgtgaacggtaatgattgtactgttttgtgtacgaaaaatttttggttgatttttagaataggaaatagtatcatgacagttataaatccgaaaaagtgagagggagaaagtcatggatacgcaattattactgaaaacggcgatgcttgccggtgaaataatgctgcgaagcggagcggaaacgtatcgtgtggaagataccatgcatcatatactgaagacggcggatcacatcgagatggcagaagttctggtgatcatgaccggaatttccgcgacgatcaaactggagaacgaaaaggcagttactgttacaaagagagtagaagaacgggataccaatctaaagctcgtcgtagatgttaatgagatttccaggcagtattgtggagatgatctgacactagagcaggcatatgagaagctttcgacgttaaaacagttcgagttcagccgcaagacaactaacctggcaatgatgggggttggtgtgggatttacaattttttttggtggatccattgcagataccggggcagccatcattgtaggactttttcttgttgcctttgtatcagcgggacaggatctgaaatttcacccatttattcaagatattttcgcaggatttggtgttgcatttgcctgctgccttctaaaagaaggtctgggtgatcagatgaatatggatactgttatgataggaagtttcatgcctcttgtaccgggaatggcaatcaccaatgctgtcagggataccttgcggggggattatctttccggtggtgcaagagtgatggaagctttcttaaaagcacttgggattgcaattggaattggtattgggctggcgctttgcacaaagattttttagcaggaaggagagcaaaaaatgaacagtacggtttttgaaatgatcatccgggtatttggagcgtttttgtctatttacagttttgcggttctccttcaggttccgcgccgctttgttcttcaggctggtattgtaggagcaattggtggatttgtttatttgcttgcaatacattttggcagaggagatatgatggcatctttatattcagcagttgcagctgcagttgtttcgcatatttttgcgagagtttataagacaccggttacgttgtttctgattgccggggttcttccgactgttcccggaaacgggatgtaccagacggttcattatctgatcgacgggaacgaggcgatgtccgaattttatctgatccagacattggagatcgcaggcgtgatctctcttgcaatttttgtcgtggatacctttttccaggcttttcagaagagtgagtggaagcagaattccatgaagtacgtccgaaagatcgttcctggagctgaggaaccgcaaaatacagaaaaacgggaaaaatagtggcttcggaatgcttgaagtaaaaaagggaatgtgttagtattataaagatgaacatatattagaatgtcatagagaactgtgaatagtctattttcacagtgaaaataaaacagaagttaaagagaggaacactaaaatgaaaaaagtcagaacaagatttgcacctagtccgacaggtagaatgcatgtcggtaatttgcgtactgcattatatgcatacctgatcgcaaaacatgaaggcggagattttatgctccgtattgaagatacagatcaggaaagatatgtagaaggtgcattggatattatttacagaacactggagaagacaggccttgttcatgatgaaggcccagataaagatggcggtgtcggaccatacgttcagagtgaaagacaggcttcaggaatttacatgaagtatgctaagcagttaattgaacagggagatgcatactactgtttctgtgataaagaacgtctggaatctttgaagacttctgtatcagaggatggaacacagattgtgaattatgacaagcattgtctgcatctgagtaaagaagagatagaagcaaaccttgcagctggaaagccatatgttgtccgtatcaatatgccgacagagggaaccacaactttccatgatgaaatttatggagatattaccgttccgaatgcggaactggatgatatgatcctgatcaaatcagacggatatccgacctataattttgcgaacgttattgatgatcatttgatgaatattacacacgttgtccgaggaaatgaatatctttcttcagcaccgaagtacaaccgtctttacgaagcatttggatgggaagtaccggtctatgtacattgcccgctgattacagatgagaaccacaaaaagctcagcaagagatgtggacattcttcttacgaagatcttctggatcagggatttgtaagtgaagcaattgtaaattatgtggcacttcttggatggtgtccgcaggataacagagagatcttctcactgccggaacttgttgaagcatttgactatcatcatatgagcaaatcaccggctgtatttgatatcaataagctgaagtggatgaacggggaatatctgaaggctatggattttgataaattctatgaacttgcagagccgtatatcaagaaagtgatcacaaaggattatgatctgaaaaagattgcgtctctgatcaagagccgtatcgaaatccttccggatatcaaagaccagattgatttctttgaagctgttccggaatatgatactgcaatgtattgccataagaagatgaagactaacgaagagacttctctggaagtattaaaagaaattcttccaagactggaagcatgggatgattacagtaatgacgcattattcgggctgctgaagggatttgcagaagaaaaaggttataagaacggatatgtgatgtggccggtaagaactgcagtttcaggaaagcagaatactccgggtggagcgactgaaatcatggaagttcttggtaaggcagaatctgtagaaagaatcaagaatgcaatagaattattaagcagataatatacagatataaaagtatgcatgggggacggatttcttttttcgcgtaatgcggaagaggaatccgttctgttgtattacatatgagaaggggagttcatgaaactaaacagaggacaggatgaagcgataaagcacgggaatggaccgtgtatggtgctggcacctccgggttcgggaaagacgcttattgtcacagaacgtacccgttatctgatcgaggagagtggagtacgcccggatcagattcttgtaattacttttacaagatatgcagcacgtgaaatgaaagaacgttttgaaaggctgactgccggaaaaaattatccggtaacgtttggaacctttcacagtattttttatgggattctaaaatgtgcctatgggattggtgcgaataatctgatgtctgaaaaagagtcctctgtacttttacaggaggtcttagaccagaccaatatcgaatcaacacctgaagtagaagatgaagaggaactggtgagagaacttctgcgggaagtcggcatggtaaagaacggactttatcatctgaaagattttcacagtaagtatcttacacaagatgagtttgcagaagtgttccgcagctatgagcatcagaaaaaagaactgaaaaaatttgattttgatgatatgctggtacagtgttatgcacttttccggaaaaagccggagattctgcaaggatggcagaagcgttttcagtatatcctgatcgatgaattccaggatatcaaccgtgtgcagtatgaagtgatccggatgcttgcagcaccgaggtacaatttgtttgtagtcggggatgatgatcagtccatttatggatttcgtggagcaaagccggagctgatgctttatatgaagcaggaattcccgtcacttcggaccatttcgctgacggtgaattatcgttctaccgaatttattaccggagcagcggcaagagtgattttgcataatgatacccgtttttacaaacgtgtacagtcatttcggggaagaggacagaatgttcatgtgcaggaagtcctggatgaacaggaagaggcgcagtatgtaacggaagagatccagaaaaaactggaccagggaataaagccgggagaaattgctgtacttttccgggcagcagtccaggcgcgaatgatttcggaaatattaagcgaacaccgtatcccgtttgaaatgcgagattatgtgaccaatttttacaggcattttattgtaaaagatatgatggcatatctgcagttggcagcaggaaagcgggacaggtcgcttttcctgacgatctgtaaccgaccactcaggtatctggcacggaacagtatggagaaccggcaggtaaattttgaggatctgcgtaaattttattgcgataaggactggatgctggatattattgaccagtttgatgtggatgtccgtatgatgaagaatatggcaccttatgcggcaatccagtatatccgaaaaaagatcggatatgatgatttcctgaaagaatatgccgaaaaacatcagatttcgtggaagcagctgatggatgtgatggcagagcttgaggagaggagtaaaaacttcaaatcctatgatgaatgggaaatccatattgcaaaatatacgcaggagctggaagaacagcaggcaaaggcaaggaagatcaaaggagagcgggagaataaggtacagctgatgacgatccattcagcgaaaggactggaatttgaggatgtatttgtgatccatgccaatgagggtgagattccgcatcagaaggcagaaaagaaagacgagattgaagaagagagaagacttttttatgtagcactaacccgtgcgaagaataatctctgtatttcctatattacacaaaaaaacgggaacagtatcaaaccgtcccgttttgtggaagagcttttaggtcagagaataaaataattattcttcaatatcaaagccttcaaattcctgtgtatcaagccattcatcaaacttatccgcagcgcggtcatactcatcatcatcttcgatattctgaagatcatgatcggagccgcctgtggtatcacggataaagcgatagatccatacgtctccgtcctcatttccaccgtcttcatcaagcggaagaagtgcaatgtattcggtagaatccatattaaaagttgtgataatggcgcattcgatttccacatcgtcatcaagtgtcagtgtgacaacatcggattcaagcagattatgttccttttccattgttcagttctcctttcaatctgatactatcactctaacagagtatggggatatttgcaaggggaaaagtattgacattagcggtaaaaaagatacaataaaagaaaggtttcagggaggtttatctatatgaagaaaaagattttttctatctttcttgtgatggttctctgtattggcatgactgcaggctgtaagaagaatgttgggacaagccaggacaatgcaatagcagaagaggacgatgacagcaaggaagaggcaaaaagctatcgttttggatttagttgtattaccatggaaaatccatactatattacacttgagcaggcactgagagaagcagtcgaagcacagggaagtacgctggtgacaaaagatccggcactgaatgtagacacccagatcgagcagatccatcagatgatcaaagacggactggatgccatttttctgtgtccggtatcaagagatgcgatcacacctgctctggaagagcttaaggaagccgatgttaagatcatcaatattgatacggaagttaaggatacggattatattgatgcctatattggttcggataataaagctgccggacagctttgtggagaagatctgatacagcagagtccggatggtggaaagattgtaattcttgaaggtcttacacagaattctattgtagagagaattacaggctttgaggaagcaattgccggaaagggatttgagattgtaggaagagcagatgtcagtggagatttgaacgaggcaagagaagcatctaacaagatttttgcagagaataaggatgttacggcagtaatgtgcgggaacgaccagattgcgcttggggcactggttgcagcaagaacagccggtcttactgatgtaaagatttacggggtagatggttctccggatctgaaaaaagaacttcagaagacggattccctgattcgcggaacaagtgcgcaatcaccgatcaaactcggaaaagaatcggccaaaatcggttttgctattttaaacggggatgattatgaaaagacaacgtatctggatgtatgttttattgatgcctcgaatgtagatatgtatggagttgatggatggcagtaacagggggaacagtggatatgaagacagcagtgggatttccgtttccacagggatgtactgtggaaggacagacagtgaatttttcggtagcagttccggaaggacagacatgtgaactgatcatttataaaaaaggtgccagggcttcagcattttcacaggagatgccatactctgatgtggcaggaaatctgcactttctctccgttgtgctggaacaaccggaagattatgaatattgttataaaatcggtggaaagatagttccggatccatatggaaaagcattttcaggcagagaacactggtctgtgtcaaagggaaaggaaaagagaaaactgcgtacccggatcgtaacagatacatttgactgggaaaagtcgcaatttccgcatctgaaaaaggaagatgtgatcgcctacagtcttcatgtccgtggatttacaaaacacagttcgtccggagtcgcacacaaaggaacgtttgacggagttacggagaaactgccctatcttcaaaaattggggattaaccagatccatctgatgccggtttatgaatttgatgagaatcagaggcatgtgaattactggggatatggaaaagcatatttctttgcaccaaaagcatcatatgcggcaggagatccggtgaatgagatgaagtcacttgttcgtcagatgcatcttgcggggattgaagttattcttgagatgcctttcacagaaggaactacgttttctctgattttagattgtctgcgttactgggtgatgcagtatcatgtggatggatttattgtgaatccatatatctgcaatccggatgaacttgcaaaggatcctgtgcttgcgaaaagtaagatcctcaaaaaagaagacggattccagaatgtgatgcgccgtttcttaaagggagatgagggcatgatctgggatgtgatctgccagctgaagaatcaggatacacagctgtataattatattgcaagccacaacggatttacgctctgtgatgtagtttcctatgatggaaagcacaacgaagcaaatggtgagaataatctggatggtccggattacaattacagctggaactgtggggcagaagggaacagccggaaaaaggcggttaacgagttgcggaagaatcagatatttaatgcgttctttttacttttatttgcacagggaatgccgtgtatcctttctggggatgaatttatgaatacccagaaaggaaataataatgcatactgtcaggataatctgatatcatggcttgactggaaccagctttccagacaggaagaattatatacatttgtatgtcgattgattgcacttcgcaaagcctgtatgaagcagacagcgaaaaaatcagaagacacgatgggcagaagcggaatccctcagatttcctatcatggggaggatgcgtggcagatgccggcagggcgtgcaagcagacagcttggtgtgttctatcatgaagaatgtacagagaaggacttttatattgcatataatatgcactggctttctcattcatttgcacttccttctcttccaaaaggaatggaatgggtgtgcatagcagggacaaaagaaggagtcctggatgaaaaagaagcagttccggtaaaagataagaaggttcagctggaggagcgaacgatcaaagtttttgttggaaggcaggctaaagaatgaaaatctggaaacatttttgcaccataacacatcacaaatatctggttatgaagaactgctttaaggtaggactttacagacagggacttttgcatgatatgtcgaagtactctccggcggagttctgggttgggtgcaggtatttccagggaaaccggagtccgaataacgcagaaagagaagaaaagggctattcttcggcatggctgcaccataaagggcgcaataaacatcattatgaatactggattgactacggactggaaggggaaccaatgcttaccgggatgaagatgcccaaaaagtatgtggtcgagatgttaatggaccggatcgcagcatccaagatttatatgaaagataaatacacggatacgtcaccgcttgaatattatcttcacggtattgcaggggactggatgcataaggataccagggcacttctggaagaacttctctatatgctcgcggcagacggggaagagaaaacttttgattatatccggaataccgtgttgaaaacgagagattattagaaaaagaggataaaaacatggcagatttaccaaaggatccaatgatccttctgagtgtggtcaatacaaaattacgggatttttatgcagatctggatactctttgccaggagatgcagattgagaaaaaagaactgacagagaaactggcatccattgattatgaatatgatgcagagctgaaccagtttgtatagagaggttaataacatatgaataatattgattttgatgcaatagatcttaccaaagaagctccggtcactgagccggagagacagtactattacattgccaaagcgcggaagtatgtaagcgaaaaagcacaggagatcggaagaaatctgactttttgcgtgacgactttcggttgtcagatgaacgctcgtgactccgaaaagctggtcggtgttctggaactgatcggatacaaggaagagccggatgaagagaaagcagacttcgttatctacaacacctgtactgtccgtgaaaatgcgaatctgcgtgtttacggacgtctgggacagcttggtgcaaagaagaaaaagaatccgcatatgttcatcggactctgtggatgtatgatgcaggaaccgactgttgtagagaagatcaagaagagctatcggtttgttgacctgatctttggaactcacaatatttataaatttgcagaactgatcgtgacaagatttgaatctgagagaatggtgatcgatatctggaaggataccgataagattgtggaggatcttccgagcgaacgcaaattttccttcaaatccggtgttaacatcatgttcggatgtaacaatttctgtagctactgtatcgtaccgtatgtgcgtggacgtgagagaagccgtaatccaaaagatatcattcgcgagattgaaggacttgtggcagatggtgtggtagaagttatgctccttggtcagaatgtaaactcttatggaaagaatctggaagagccgatgacatttgcacagcttcttcaggagattgagaagattgaaggactggagagaatccgctttatgacttcccatccaaaggatttatcagatgaactgattgatgtaatggcacattccaagaaaatctgcaagcatctgcatcttccggttcagtcaggaagcagcaggatcctgcagaagatgaaccgtcattacaccaaggagcattatcttgaggtggtaagaaagatccgcgaagcagtgccggatatttcccttacaacggatattatcgtcggattccctggggagacagaggaagatttccaggatactctggatattgtaagacaggtgcgttatgacagtgcctttacttttatctattccaagagaacaggaacccctgcggcagcaatggaagatcaggttcctgatgacgtggtaaaagaccgttttgatcgccttttaaaagaggtgcagcagatttcggcggaagtatgctctgtacatcagggaaccacacaggatgtgctggtagaaagtgtcaacgatcatgatctgtcattggtgacaggacgaatgagcaacaacctcctggtacatttcccgggagatgaaagcatgatcggtaagatcgtgacagtttacttaaaagaggcaaaaggcttctattatatgggagaactctgtaaataaatccaatgatttgtgataaaatccaaaagaaacgctcatgctatgtaagagatttgcatagtgagggcgttttttatggtgaaaagagtgagtaaaagggtaagtgagatagtctttctgatagcagcagggggaagcacctattatctgatcgagatctggtttcgtggattttctcattggaccatgtttgtgcttgggggagttgcattgacattttgcagttttcagggcgaggtaatgcactggtctgagccgatgtggattcagattatccgggcagtgcttttcctgacatccttggaatttatgacggggattatctgtaataaatggctgaagatcgggatctgggattaccgggatcagccgttccagctgtgtggccagatctgcctgccgtttatggtgatgttttcaggacttttatgccttgcgatcgtccttggaggagtggtgctctggggcgtatatggggaggaaaagccggagtttcatgtgttgtaaaatggacttaagcattttttatatgtgaaaaatgacgaaattaagatgaaaagagtcgtgggaaaccaaattcttttcatctttttttgtggatggttacaaaaatgagcataaatgcattttgttaaatgtaaaatgttgacaattttcgaagaattcagtaagatacaagaaaggttcaagataaaaaacaagtgaatataatcatggaaaaaggagggcagcaggaaaaatcggggaaaatataaactgttttttattgaatgagaagtatatgttatttggaggaaaactaaaaatgaatcaatatgatgaagccttaaaaaaggagaccgcgtttttgggtcagcctagggggggtggggactctcagctttgtacagctttgttcgtctttttcaaactacgcaatgaatgccgtaatgatctattacctgtatgcaaatgcacctgcaggtcttggattcgataaagcggatgcagcacagttgatttctttatatgcaactgtagtcggaatgacaaccatcatcggaagctatgtctgcgaccgtattcttggatgtcgtaggtcactgcttgtagccagagttaccggatttatcggttataccttgcttgcatttccacttggggtagttggatatgcagctgctatgggatgtatggtattcggttcactcttcgcaggaagatgtatcgaaactctgatcggtaaattctacgatgagaacgatggaagacgtgacagtgctttcacaatttcttacgtaatttccaatatcggtgcagcagctccggcccttgcaggtgtaatcgcagcgaaatgcggatatcacgcagcattcgcattatcagcagttctctcattcttaggtactgttgcttatattgctacttacaaaaaattcttcggaaatatcggtctggaaccggatgatccgcttccggcagataagaaacgttcttttgttgtaaaaatgcttattgttgttgctatcgtaggaacagttttagcagtttcatttgcaacaggaaagctgaaaatatcttcctttgcaaacgtagtaagtactatttccatctttatcccgcttgcttatcttgtcttcatctactcaagcaagaagacagaaaagcacgagaaaaagaaagtactttgtctgcttccaccatttatctgtaacgccgttacacttttgatctggacacagacaatttcaatccttgctatcttctatgaagaaaaagtaaatcgtgtgatcttcggagtagaaattccggcagcttcattccagacaatcccggcaatctttgcggtttgcttcggtagtcttcttaccatgctttggacaaaacttggcaagaaacagccattcggaacaacaaagatgggattcggaacgattttgtggggacttggagcaatgattattgcactcctttatatcatttacccaggcgatgcaaaagtaaatgcatggtggatcgtattgttctatgtagtactgatgtttgctgaaggatttacatgcccgatcggttactccattacagcagtagcagcaccaaaagcctttgtaacacagatgatgactgtatggtcaatgtctcagtcagtaggagctgctcttaacatgatcctcgttaacttctataaagaaggaagcgaagtgccgttcttcatcggaatcggtgcagttgtagctatccttggtgcagtcgtactcgctttcagcaagaaacttgcagaaggaatgggaatggaaagagaagcgtaggaagtttctcgagaataaatcaaataaatgtcctcttaaagaagaagtaataaaaagtatcaaaaaaatccttgtcaggcagagatgtccggcaaggactttttgattctataccattttgcaatattttgtaataaaggaggaaagtgaggtggacagatttaaaagaatgctgcgattattacaatataaactataaatccctatgtacttatatgcagaaaaataaaatatcaaaagaggaggcgttcagccattattatcagtattataaatataatcgttttacatataaccatgtgacttatgacagtttcgtcgcatgctgcatggcatatgagattaaaccgatctgcgtccggcgatatgcaaaaagaaagcattttctgctgcggcatgcgctttccagctatttgaattatcataataaaagaaaaatatatttctgcggacaggaatatattacatttacatcatgttgcagagcatttggatgcaatgcatcttatgtgtcggcatacgcaaaacggcacggaatatccagagaagaagctttgaaattttatatcaatcggtgtcattaaaagcggtgcgcaatagagcatggcgaaagaattgttcggcacaagaagcattccggcattgtttgaaaaggaagaagaatctggaaatggacgcgttttactataaaggtgataggtataaggacttgaaagaatgctgcaagcaatatggaatcaatgttcaatctgtgcattcttataggttccggaataaagacagcgattatgatgaggcgattgattatattagaaagattacgaaacagcggcaatttatttgggaggatggaagtgtatatgaatcaatcaattccttttgtagaatgaaaagtatctctgtaagcagtgtgagagataaagtaagaaagaaagggatgtctttacaggaagcggcaaaatattatattgagagaaatagttatgactgatgagtacgcagtataagcggatggtagaatttgagagaaatatgttgctgtttattgcaattgtgataaaattaggataaaataaagatagcaaaaagtgaaaggagaggtggaaatgatacaaattcgcccagtttctgatctcagaaataaatttcctgaaattgagactcttgttaatagtggaaatcctgtgtatttaactaaaaatggatatggagctatggttgttttaagtttagaagagtatgcaagcctcactgataatatcgaaatgaagcttgatgaagctgacagacaggctgcgggaaccgatgaaagactttctcacgaaagcgtgttcaaaaatgcaaggagtgcaatacatggaaaataaatcttatcagcttcgctacttgtcaatatttgaaactgatttgctaagtacggtaaattacattacaaatgtcttgaaaaatgaagatgcagcacatcggttggttgatgatattgaaagtgccatattgaaaaggctggaaaatcctcttgcgtttgaaccttattgttctgcaaaaaggagagagtatccatattatcggatttatgtgaggaattatgtggtatattatgtggttatcgggaatgttatggaagtaaggcgactgatatatagtgcgagagatacagatcgtcatttatagcagaatgataaaaatgtaattgcaaaatagcgataatttattttagaaaaatagtagtaggaaacaatacagaactcctctatatgagaataaagttgttctcatatagaggagttctgtattctcaattaaatatttgaaagtaagtatgtgaaaaaattaaaaacttgctgaataagcaaaaagttgcgggtacagaactgtataatcgaaaacaaaggaaatgattttaactttagtaaaaatgagaatcatatgaggaatgcgaagatggaaagaattatcaatattgaagattcagtaatcaaacattcccatcaagatacagtctcgcatattctagtggttcatcaatggcaagtgtgtttaatgcacaatctgatccgggtgtggttctcaaattcttttctgtttcccagcagtcaatgcgaagcatatagtctgcactggtataaacatcaatgctgtttcgtccgggattatattctgcaaatattgttctcatcgtatcttatctccttatcgttcaatcaattatttgctacaaaaatcagaagcatttcaatcagttcaccatgtcacttttattttgtgttatactgttttatataatttttttggtctccgctgccgcttcggtcagcacagagcagaggtccaccggacctcttgtgcccttgtattttcccttatcagagttcgtaaacactggtgggacgatataacacaagggaaacaataagggaaagctcacctgcgacaaatccagtgttttcaatggtttgcggagaatttaataacaaaatataacagttattaaatttcttaaaacaggtgaaatctcaatcggtatttgtgaaggaggaatatactatgaatatagggttttggctatgtggagttttggttattccatttgtgattacaggagtgttatttgcaatatttaaagaaaaagcggctaaatttgtttcgggatttaattcattaccgaaagaagaaaaggcattgtatgataaagctcatatttctcgtgatataaaaaatcagtgttttacatgggctggcataatgttagtaggagcagtgttgtcttattttttaacaccatatatggctattccggcttttattatttggctcgttttatttttcaaagaggttcactttgacacgcacaaagcatttgaaaaatatttattaaaataaattccagatgataaagcagaagtatagggtttgattcatatgatttcagtaaaaaaacagagaattgctgctattatggttttaagttccatcatgctgattttacttttgtcgctaaatttccgactctggagtggatattatgcagaaggggatttggaaagtatagtcatacagcagatggaatgcttggaaaagtcaaatagtgaaaacgatataagcgaaagtatatgtttgcatttctatgagtgtatatgtttcggtgaaatagaaataatggtgctctgggtatatgatggctttaaagacctcggacaaggtgagttttctttcagaccgggagttaccctttgcagtctatcggttcggatggatgattaaatacttctgataatcaaatttaaaatttattatcaggaggaacttcgatgtatgtattaaatgcaaatcatatttcaaaaagttataaaactgcaggagaaactatgcggattttgcagaatgtgaatctgcaagttatgaaaggagaaatggttgctattatgggaccatccggcagtggaaagactactctgctccatgtgctgaccggggttgacacgccggacgatggagaaatcgtaataggaggagaaacattttcacaacttacggaagaagagaaggcattttttcgcagaaagcatatgggaatgatttttcaggatttccagcttttggagagtttgacggtaaaagaaaatatattgttaccactcattcttgaacgaaaagaagcagacatccagcaagagcgtttttcaagaatagcggatgtgctcagcattgaaaaattagctgacaaaggaattacggaaatatcgggaggtcagaaacagagagttgcgattggcagggggctgatcaatgaaccggatattatttttggagatgagccaacaggaagccttgaccgaaagaccaccggggatgtgatgcgatgtatgaagcagatgaatcaacggtctggcatcagctttctgcttgtgacacatgatgcttatacggcatccttttgtgaccgggtactttttctacaggatgggaatctggcaaaagaagtaaagaaagagaacactgccgataatttcagagaagatatatggaaaacgctgtgcggtttgggaggtggaaaagatgaccttttttgatatttcccgaaagatgctgaaagctggtttttacaaatatcgattgtactttctatgcaatttatctgcaacggcattattctgttgttttgcagttatttccacaaacaggacgtttatgaatgcgtcgattgtaaattcatcaatatccaataacatttatcttccattttttctgtctgcagtgtttctggttttttttcttcctgtttcgtgtcaggcatttctggcatcaagaaaacaggaatacggcgtgatgttttctcttggcatgagccggaaggaagcgtttagaaacttactttttgaaaatgtgatcatatccgtgctggcattagcaatagcacttgcggcaggaactgtgctgtcatttttatttttttccgttatcatttatgcaatagatgttcacggagtgcaatggcagttttgcccggaagcatataagcttacagcagttctatatacagtagtggtggcagttgcctttatcctgaatgccgggagacttatgctggacaaaatcggaaccctgctaaaagcacaatatcgggcagaaaaaacaggaaagatcggtacgttcttatgcagacttgcacccaactacatgaggtttcatctggtggaatggtcatttgtccgcagacacaagaaagaatggggatgtaggtatgttttagcctctctcataatagcggtatctgttatgcttacgggggtatgtgtgactttatatccggcttttctagaggatgcaaaaagttattctccctatgacatggtgtactcagaaatctatggaatgaatcaggtttcagtacaggatgtccttcatatattggagaaaaatggtgttactgtagaacaggtcattcagcttccctatatcagagatgatgtttttaattaccttcctgtgacagaaataaaccgggattttggatgtgattatcagattcaggaaggcgagtttttgaatttgtttcagtacaatctggaagatgggtatgaacataacatacagccagtatctactgtaacgatttccggggacagaaagctgcagtctgttggaacagatgtaaagatactgtttaatcaaaatccgacctttgcagataaaacactgatcatcaacgattctgatttcgaaaaattaagtgcagatataacaggtagtgctggtatcgcaaacttgtttcagtttcagaattgggaagattcttatgcgggagtatgtgaagtaaaagaatatctgcaggaaagcaatcagttgaatgaagatgagcagacgtattatgaattgtcttcgaaagtggagaaataccaggatgcaaagaaatcaggacaatttttattatttttgatggcatttgtgatagggcttatgataatggctgagtttctgttaattcattcacgtatccaggcagagaaggaagaaaatagcagggtcgtttgtagtttgcgaatgttgggaatgatagacaaggaaatggtaaagtgcctatgctataagaattttctaagatttataccgccatcggttgtgggaacaatcctttctttcctgccatcttattatctgaatgagagttatggaatggggacgaatggaattctggcaggaatcgtatttggagtgattttgacagtcggaatattcgtagtgatacgcaggtattctgaaaaagaagaaaaactttatgaaagcggttttataatacaaggaagaggattttttgattatagataagtagaaaaagattcaaatcctgtgtataattaaaagataaagatagagacaactcggaatttacaggaagtgtgacaagaaagccaaaacggtatactgggaaaaaaagattaagaaaagaataaagagctggttttaattgtaaaatttatggggaactaacatcagcttattgacataaatttaaaaataagtataataatagttgagtaattgttcaactattattatttggaggtgaatatatgtcaaaaacgtcttatatttgtaattgcgatgtaattcatgaggatattgtgaatgatgtgaaatccaagatgcagccaaaagatgattatatccagttggcttctttgtttaagctatttggagatggaactagagtacaaatcttacacgctctagaacagagtgagatgtgtgtatgtgatcttgcagtgctactgggggtaacaaaatctgcaatttcgcatcagttaaaggcattacgcctagcgaatctggtaaaattccgtaaagaagcacagatagtttactactcgctggcagatgatcatgtgaaagagattattgacaagggatttgagcatctttggcagaaataatattttttaatatcatagttgagtaattgaacaattaaacaaattataaggagattatcatgaaacgcacatttctattaaaagggttggactgtccaaattgttccgcaaaaattgaaaaagaaatcggagagttggatggagtgcaatcctcagtggtaaatctgatgaagcagacgcttacaatcaatgttactcagacagccgcagatacgatagccagtcagattgaaacgattgttcatagtcatgagcccgatgtggaagttcaggaagaaaccgttatgaatgttacaaagagttattcgttaaaaggattggattgtccgaattgttctgcaaaaattgaaaaagaagtcggagagttggatggagtgcaatcctcagtggtaaatctgatgaagcagacgcttacaatcaatgttgctcagacagccgcagatacgatagccagtcagattgaaacgattgtttatagtcatgagccagatgtggaagttcaggaagaaaccgttatgaatgttacaaagagttattcgttaaaagggttggactgtccgaattgttccgcaaaaattgaaaaagaagtcggagagttggatggagtgcaatcctcagtggtaaatctgatgaagcagacgcttacaatcaatgttgctcagacagccgcagatacgatagccagtcagattgaaacgattgttcatagccatgagccagatgtggaagtttctgaaattgtacaggaatcttatataccggaaaaaaagcaggaggccaatgaatcctataacaatgaggataagaagttgacagttcgtttagcgactggtgcagcaatctatgccattggtatggcattgactgtttttgcgaaagtgccactgcctatcgagttagcttttctcattgtttcttatgttattcttggtggagatgttgtatggaaggctgtgaggaacatttcaaaggggcgtgtatttgatgaacattttttgatgagtgtttctacgattggggcttttgtcattggtgaatatccagaagcagttgctgttatgctattctatcaggtaggtgaattttttcagtcattggctgttaagcgttccagaaaatctatatcagatttaatggatatacgtccggattgtgctacagtcagaaggaacggagaattgattaccatatctcctgaaagtgttgccattggcgagattattattgtaaagcctggtgaaaaaatcccattagacggtgtggtattggatggagattctatgctggatacgagggctttaactggagaatcggttccgagaagcgttcataaaggagacgaagcactttccggttgtatgaatcagacgggtgttttaacgattaagacaacgaaagtatttggtgaatctactgcttcaaagattattgatcttgtggagaatgcgtccagtagaaaagcaccaacagaaaatttcattactacatttgcacgttattacactcctgttgttgtaatcttagcagctattctggcaattctgccaccgatccttcttggtggaggttggacagagtggattcgcagaggatttgttttccttgtggtatcttgcccatgtgcattggttatttcaatcccgctgactttcttcggaggtattggtgcggcatctaaacgaggtgttcttgtaaaaggaagtaattatttagaggcgcttaataatgtcagcattattgtgttcgataaaactggaacacttacaaagggtgttttcaatgtgactgatattctgcctgcaaatggattttcaaaagaacaggttctggagtatgcggcagaggcagagagtttttctaaccatcctattgcaaaatccattcttgctgcttatggaaaagaaattgatcagtcagtgatttctgattataaggaaatttcaggatatggaatcagtgtaatggcaggggaaaagaaagtttttgctggcaatacgaaacttatggatacagaatgtatagagtacacaacctgtgaaaacgcaggtacaaaagtttatttggcggtagatggtcaatatgcaggatgtattttgataacagatgaagtgaagccggacagtaaaaaagcaatttctgacctgaaacatatcggcgtggaaaaaacagtcatgcttaccggtgatgatgaaaaaattgggaagtccgttgcagaagaattgcagttggatgaatattatgcacagctgcttcctgaccaaaaagtggaaaaggttgagcttttagatagtaaaaagagaccgggaagcaaattggcttttgttggtgatggtatcaatgacgctcctgtccttgcccgtgcagatgttggtattgcaatgggtgggcttggttcggatgcggccattgaagcagcagatgtagttctgatgacagatgaaccgtctaagctggtggacgcgattgaagtagcaaaagcgacaaaacagattgtcatgcagaatatagtgattgctcttgggattaaaagtgtgttcctgattcttggcgctcttggtattgcgggaatgtgggaagctgtatttggtgatgtaggcgttaccataattgctgttttgaacgcaatgagaattttgaaagaataggaaatgaggtgggaatgtgaaacgaaaactgattctgttagttgttacgattgtttttcttgtaggttttggtgccattttacattcaccgccttctatgattgatgcagtcacaggagcaacaccgaagtcaaaaaaggcggctcaagcctccgcacagttggaaggctcttatgttctcagtattaatatgatgtcagatggtctcgacaacgagaacacccggaataaattaaaagaattggcactggacgattcggaaacaaatgaaacagatctcatgaaaacggacattagttttcggttatatgtatctgagacggattatccgcttgtcagttatgctaagaaactctgtgacagattgaaacaggccggtttttccgtagatctgaaagagtacagtaacacaatgatgctatcaagagtggtaagtggaaagtatgatgtattcctggcatcggatgattttattgacgttacaacgttatcacagatggactatatgatcatggacagcgaagaaatgaggtgagcgggaatttatgagaaaatggaatacgattttgtctgttttaatgcttctcatttttatgattcatggaatcatgggaagctttatgctgaacggagttggaagtagtgcagggaaacttcttgcatggattggtgttggtattcttgttgtgcatacggtgattggtgtcatcctgacagttcagagtttacagacagcgaagcaatccggaaaaatgtatctgaaacagaacgccatattctgggcgagacgagccagtgggctggcaatactgatcctgctgttcttccatattggcttgtttggaaaggtgcagaatgggacatatattttgttcccttttacaacggtaaagatggtaactcagcttttgttcgtggtggcaatctttgttcatatttttatcaatatccgcccattgctcgtatcgctgggaatcatcagttataaagaacgaaggggtgatatttatttgattctttcggtgctccttctgtttatagcgggcgcagttattttctattatattgggtggcaatatctatgagtaagacaattattattataggtgctggactggcaggactttcagcgactttgcaggcaacggaaaatggatgcaatgtaaaactggtttcctcccttccgtcagagcgggcacagtctgttatggcggagggcggtatcaacgcagctttgaatacaaaagatgaaaacgacagtcccgaagaacattttacagatacaataaaggcagcatgtggtctggcagatccaaatgcagtttggggaatgacacaggcagcaccggagctggtgcactggctgctaaaacttggagttaaatttaacatgagtggctatgatgatgtggatctgcgaaattttggcgggcagaaaaagaaacggactgcttttgcacagagcgataccgggaagcagatcatgacagctatgatagacgctgttcgcaggaaagaagcatttggtatggtagaacggttcagccatcattctttcctaacacttcgtctgtgtggcaatatttgttgtggctgcgtaatcagggatgaatacagtcaggagactgtggaattaccgggggatgcggttattgttgccaccggtggtatgcacggattgtttggaaatacaacgggttcgctgagcaatacaggagaagtcaccgcagaattgttccggcttggtgttcctctggcaaatggcgagatgatccagtatcatccgacaactgtgaaatgtggtggaaaacgcatgctcatcagcgaggcggccagaggggaaggtggcaggttgtttgccatgaaagatggaaaacaatggtatttcatggaggaaaaatacccggagcttggaaatctgatgccacgagatattaccgccagagagatatggaaggtcagccatgaatcagaggtatttcttgacatgacggaaatatcggaggagattatttcaaataagctatctggtctggcagacgattgtatgacctatttgcataaagatatacgaaaggaaccggtgtctgttttaccgggaattcactattttatgggaggtattctggtggatgagcagcacagaacgccgattcagaatctttacgctgccggagaatgctgtgcccaatatcatggtgccaaccgtcttggtggaaattctctgttaggagcgttatacggaggacgtgttgcggcaaaatcagcatgcgaacaggcagatgtagtagatctatcttgtgcgacacagatagattttccaccagcgtctcaaatttcagaaataaagcaattaaacaaagtgatgcaggagactatgggcgttgtcagaaatgagaatacgttgttaaatgggattcaaacggtacaagcgctgacaggaaatcttccattgcttggcatggcagttctaaagagtgctcttgcaagaaaagaaagccgtggtgcacactggcgggaggattatccgaagagcaatgacaatgattaccttaaaacaacggtagccagatttgatggaaagcagatacagatttcctttgtacctgttccagaaaggcggtgattcacttggtatataaaataaaaatcaggcggcaggagagtcagaaatcagatagttattggcaggaatttgagtttgacggaagcaaaaacagctctgttgccactgttctaaaggaattgaacagtagaactcctttgaaagataactcaggaactatagttactcccatcagttgggaatgtagctgtatggtgcgaaaatgtggggcttgcgccatgctgattaacgaacgtccgaggctggcatgctctacatttctacatatgttaaaaggttctacaatcaccttggaacctttaagcaaatttccgcttgtaagagatttgatcgttgaccggtcaaatctgtttgaaaatttgaaaaaactgaacctttggcttgaaagtgaagcttatatgagttcgtggacacatgaaccgagataccagtcggcacgctgtctgatgtgtggctgctgccttgaagtgtgtcctaacttctctgcaaatgggactttcgcaggcgctgttgctgcagtcaacgcatttcggattctgaatgaagaacaggaaagcactcatttgaatgagatttctgctgaatataagaagaaatattttgagggatgcgggaagtcgttatcttgtcatgatatttgtccgattggtctgcctgtggaagaactgcttgtaaggtcgaatgcagcggctgtttggggcaaataaaatggatgataaaagctataatgaatgtatgaagagaatcaaaaacttgattctcttttttaaaacacatacattggcaaatatctatgtatatattatattgaacatagacaatgatcaatgtgaggtgtcaatatgaatgcaatggatgtggctttgatatgcaaggctttgggcgatgcgaaccggctggaaattgtacagatgctgtcggatggagaaaagtgcgggtgtaaacttttggaaagatttgaaattacccagccaactttatctcatgatgaattttccggaaatattgtagctaatagttatttaaactgttgtatttgtttaaaaattaaaaaatatctaatgagtcttccgcatctacccacatctgcaaatttccatcaagatataatcttgcatattcaagaggatcatcaatggcgagtgcgtttaatgcacagtctgatcctgatgtggtttttaagtccttttcagcttcccaacagtcaatgcggagcatatagccaacagaggtataaacatcaatgctgtttcgtccgggattgtattctgcaaatattgttctcatcgtatcttatctccttatcgttcaatcaattatttgctacaaaaatcagaagcatttcaatcagttcaccatgtcacttttattttatgttatactattttatataatttttttgcccttgtattttcccttatcagagttcgtaaacactggtgggacgatataacacaagggaaacaataagggaaagctcgcctgtgataaattcagtgttttcaagggtttgcggagaatttaataacaaaatataacagttgttaaattgcttaaaacaggtgaaatctcaatcggaatttgtagaattagtaaatctcgattttgggaaatacaagaatgtgtctcattatggttttaatgcggtttgtaaggagaaacaatatgattgggtttgttatatggtcactttttggagtgtttataattggattaggaataaaagatatgttttgtaagaatcccgttggattctgggctaataccgaaacaataaaagtaaaagatgtgaaaggttacaatcgtgcgagcggactattgtttataatctatggaatcatttttgttatattaggaattccgctgttagaaggtcaaaatacaccatacgttctgttgtcggttattggtgtgatggtggaaacaattgtaattatggctgcttatagtttagttatcgttaaaaagtatgaagagaagtaaataacttataatttgtggaggataactattgtggataaagcagttatttatatacatggaaaaggtggtaatgctgaagaagctattcattacaaaccgctctttagtaattgtgatgtgattggtctcgactatactgcacagtttccatgggaagcaaaagaagaatttccattactttttaattcaatttatagaaactacaagacggttgaagtaattgccaatagcattggagcgtattttgctatcaatgccttatcaaatcagcaaatagagaaagcatattttatttcgcccgttgtagatatggaaaggcttattgctgatatgatgatttgggcaaatgttacagaggatgaactcaaagagaaaaaagaaattcagacaacctttggagagactctttcatgggattatctttgctatgcaagagaaaatcctattatatgggaaatcccaacgcacattttatatggtgaaaaagataatcttaccgcttatggaacgatatttgaatttgtacagaggactaattcaacactttctattatgaaaaatggagagcattggtttcatacggatgaacaaatgaaatttcttgatgaatggataataaaatcttccaaataaattcaagtttggagaattgagaaaatcggaattttggaggttattatggcttttgattttaaaaaagagtataaagaattctatatgccgaagaacaaaccagagattgtaaatgtacctaaggcaaattatattgcagttagaggaaaaggcaatccaaatgaagaaggcggagcatatcaacaagcaatcagtgttctatatgctgttgcatacacattaaaaatgagttacaagactgattataaaattgaaggattttttgaatatgttgttccgccattggaaggtttttggtggcaggatgatgtcgagagtgtagattatacaaataagtctgctttcagctggatttctgttatccgtttgcctgatttcatttctaaagctgattttgactgggcggtagaaacagcaacgaaaaagaagaaacttgattgttcgtcagcagagtatcttacgattgatgagggattatgcgttcaaattatgcatataggttcttttgataatgagccagcaactgttgcgcttatggatacttatttagaacaaaatggatatgttaatgatattaacaaagataggttgcaccacgagatttatatgtctgatgcaagaaaggttgccccagaaaaatggaaaactgtaattagacatccaattaagaaagcgtaaaattcccgtttattgggaagtcgcagagaacgaaaaatcggaattttgctttcgatgaccagaatgaaaatcgttaccgttgcgcctgttttcacaagcgttgcgtgacataaaaagaattcttttttaatatcaaagtatcaaaaacaaaggaggttctttttatgttgaaggaattaaagaaaaacaaaatgagtgttgttgcaactggaattttatttggtgttatgggggtattaattattcctatgatagcagtaattgtaaaaatatcgaatgcattatcccaaaaacatcctaggatatacaagtatagtatgattgcttttatcggtatgttattggcaattaacctattttgcgttgttattaaacatcagatgagttttcttgtaatagttgcttgtttagcaataacattatgcgacactattaaaaacagataataaatggagtacaactatggaaatatcagatttgattaaatcagccagaattgaaaagggcttaacccaacaacaactggctgatgttgtctttgttacgcgacagacaatttcgaaatgggaattgggaaaaagtgttcctgaccaagcctctcttatattgctataccagtatttggacatcaaggataatgagaaaaaacagttatcaaagcttatttttaataagcaaaatattatattaattttgattgcaatcttattttctcctatggttattggagtacgttttatctgttgtaaaattgataagattgaaaatcgaaaaattaaagcggtaatcaaggttattggctttgttgtattctcatcgtatctagtatctttaaaagaaaatgtggcgtatttgttaattggtatattttctctggtgtatttgttatatcaattctatttgagtggattggaaactaaatgacaagattctggcaaccatgcgttccagagggatttcctgcagtatcatcatccagaacattgcacagatgaaagtggttctttggtcattatcatgataataagaatattggaccgagagaaatactgatatatgaacagattattcggatactgtgagaaattatgattcatgaaaactaaatgtaaatcgaaaactgtttggcaaaactttatatgataattgaaaaaacagctgacttgcaataaaaaaattttgcaaccagctgtttatttatcacctttttcaattttaactaccgcttctataggacaatctaaaataacacaaatatcatgtagagtattcatggtaacacttttgtttttcctaagagcatctaatgttccagtgcttatgtggtaggttttgattaattcatattgagaaatccccttatcttttaatgtctgccataatggggcgtaggtaaacaaatgtatcacctctttcatgcatgttctatatttaattatagggttttcaattaccttacatattgccgaatattcgactataataaacataacaagagagcaaagattagatacaatgtagttcaaatatggagaaagatatggaaaagtgtgcagaacagcaaaggctgttattccttggtatgtgtagtttggaagaccgaaagagaatttgtgatgaaaaaataatggatttatataattttgagcgaattacttatttgctggaagcgtttggatttgaagaatataaatttgtatttgaaatgaagtataaagatctgctactgaaacttgcggatattgttgagcagaatttagtatgtggaaattctatggataaatatgtgttacaggataaatacgaaataagaaatgagtggcagcaagagtttgttagaaatttgcccaatgaagtaatgaaaaactgtattcaggagatatttgatttgtatgcataaatgctagatttgtttcgacttaatatatttgtgtacagaaaaaggtatgacataaaaataataaaggattatgtgcgaaaattggaacctggttccaatttttgtgctttatgccatattcaaacagaagggagtgataataaggactatttgttattctgggaaccgaaaaataaaatgagattttcttatcagatagatgttgaatttttagcttatcttgaaaagaatttaaaaatttgttaagatggaacaggtaagcaaataggtagtcatctgtctgttagaaagaagaaaaaggatggatgagtatcatggctaaagccttaaatgggaaagagttggggaaaggaattactcaactgagaaatggaacctatcaagcacgtgtgtatattaaaggaaatgacaaacctatatatgcatccagtaaaagattagaagaagtaaaacaaaagagagaaaaaatattagaacaatataatctaggattgcagactgatgccagcaaaaaaacgttaaatgattggtttgatgagtggatggagttatatgtggttggaaaagtgaaacctaggactgtacaaaactatataagagagtatgaaagatgtaaatcttatatagggcatataaaagtaaatcaattacaaccgacatatatccaaaaaatggtaaacgaattatttaaaaaaggatataagagggcaacggttaaacaatcagtatccgtttgaggagaattttgtgaataaagaatttgataaaatacgagaaaaaatgtaaaatacctagaagttacaaatggaaataactgagcctgcgaggaagcaaagatacgatggttttctcgtaggctgacagataaaaaagagaataattataacaaacacgcggataaatatgcaaaaggctattagggaagaaagtacgaaagtttagaaaaccgtgtaaaaaccgtgtagaaaaaaagtggaaagtgctgaaacccttgtaaaataaggagattttgatatgactggtgaactaacaccgaccgcctgataattttaaccctacaaaaacgcgataaagcgcgtggttgagggatttttttatggtcggaaaagttgtctgaaagttctgacaacggcatggagtgtactgtagtgttgtggagtacattggagtacatggtcaaaaaatggtcacaaatgctttttcccaaatgcatactcatacatactcatgcatattgtgtaacctttaatgttagttcccctatgtttgtataattattccgttttttattctaattcaattcatttttatcttttcaactgttaaatctaaattttgcgtttctgcaaaatcatttatacaatttcctgagatcaggtattttatacattgaaataaaaagaaggtttcaatttatgaatatcaataacagtaaatatatcttctatgcatttaataagaaatggaagagtattcgtgagtgttgcaaatactatgaagtaagatatggatctgttatgtcttacaaaagaatccacaagtgtacagctgaagaagcaatcgcatattgcagaaatttgaaaaaactaggtatattttattttaagaaagtgaggtggacagatttaaaagaatgctgcgattattacaatataaactataaatccctatgtacttatatgcagaaaaataaaatatcaaaagaggaggcgctcagccattattatcagtattataaatataatcgttttacatataaccatgtgacttatgatagttttgcagcttgttgtgaggcttacaatattaaatcggtttgcgtcagaagatatgcgagaaaaaaacattttctattgcggcatgcatttgccagctatctgaattatcataataaacgaaaaatgtatttctgcggacaggaatatattacatttacatcatgttgcagagcatttggatgcaatgcatcttatgtgtcggcatacgcaaaacggcacggaatatccagagaagaagctttgaaattttatatcaatcgtattgaaaagcaggaaggacaaaaaatagattccagaacatttgtattccgggatagtatttatcatgatttgagtgactgctgccacaaacttggtataaatgtcagcagcgtttatggttatatgtggagaacgaaaaagggtaaagtagaggcggttgaatattactataataaaaagatggaggattattttgaatgggagtcggttttatactcgtctttgtcggcatgctgtacaaaatttgatgtgtcattaaaagcagtacgcaatagagcgtggcgaaagaactgttcgatccaagaagctttccgacattgtctgagaaggaagcaaagtctggaaacggatgtattttactatagaggtgatgagtataaaaatttgaaagagtgctgtgaaaaatacaatattaatgttcaatctgtgcattcttataggtttcggaataaagacagcgattacgatgaggcaattgattatattagaaagattacggaaaatcggcaatttatctgggaggatggaagtgtatatgaatcaatcaattccttttgcagaatgaaaagtatctctgtaagcagtgtgagagataaagcgagaaagaaagggatgtctttacaggaagcgacaaaatattatattgagagaaatagttatgactgatgagtacgcagtataagcggatggtagaatttatgagaaatgtgttgctgtttattgcaattgcgataaaattaggataaaataaagatagtaaaatgcgaaaggagaggtggaaatgatacaaattcgcccagtttctgatcttagaaataaatttcctgaaattgagactcttgttaatagtgggaatcctgtgtatttaactaaaaatggatatggcgctatggttgttctaagcttagaagagtatgcaagtctcacagataatattgaaatgaagcttgatgaagctgacaggcaggctgcgggaaccgatgaaagactttctcacgaaagcgtgttcaaaaatgcaaggagtgcaatacatggaaaataaatcttatcagcttcgctacttgccaatatttgaaactgatttgctaagtacggtaaattacattacaaatgtcttgaaaaatgaagatgcagcacatcggttggttgatgatattgaaagtgccatattgaaaaggctggaaaatcctcttgcgtttgaaccttatcgttctgcaaaaaggagagagtatccatattatcggatttatgtgaggaattatgtggtatattatgtggttatcgggaatgttatggaagtaaggcgactgatatataaaagcacttgataaggaactgtaagttacgatgttaaaaagtagaagttactgatgatggaacgccggatgaggggaaactctcatgtccggtgtgaagtgggggaaagtctggcgataacatcaaaggattatctatcactataggaccgtttgattgccctgcatcatttggatattggttggaaaccatctgacttggaacgtgcgcccgtaaaggcatcataataaatatacctttggcaaggtattaggatagtatcttacagtcctatcatcaaccgatttacctgtgagggaaactaaatatcagggaaaatagcacgtcggtaaagccataagtcagctaattaccaagctgcgactgaatggggagatgaaaagttaggtatgaggataaagcccatactggttgaacgatagtccaaacggtcaatgtcgggactatggcgtaaggtaattattattcgccatatctcagcacttatgttccgctgttcaggagcgtaagcaaagataggctgagacgtatatgcaataagcataaaaggatggaagtcgtatccgacaacctaacaagccaaatcgttagtatgatgctaaacggggattacctaagtcgaaacgcttaaaaataagctattaagtgtaggcttatgaatattcgatatggtaacggagccttcatagtagtccgagagtgttaatggcacttacatggcgaaggaaggcagtttataacattaacaatatagaaaggataatgtgtgatacattatgagaaatcctgaaaatgtgttaatcagcttaacgaaacacagtaaccaaaaagattacaagtacgagcgtttataccgtttgctctacaatgaggaactgtacttaaccgcttatcaaaacatttattccaatgacggaagtatgacaaaaggtactgacaagcaaacggttgacggtatgagtatcgaaagaatacggaaaatcatagtttcgctcaaagatgaaagctatcagccaaaacctgcaagaagaacctatattccaaagaagaacggaaaaatgcgtccactcggaataccgtcctttgaggataaattgcttcaagaggttatcagaatgattttagaagctatctatgaggggcattttgaaaatacttctcatgggttcagacctaatagaagctgtcatacggcactcaatgaaattcaaaaaactttcacgggtgtgaaatggtttatcgaaggagacattaaaggtttttttgataacatcaaccatgctacgttgattggaattttacgagaacgtatcaatgacgagagatttcttcgactggtaagaaaatttctgaatgcaggctatattgagaattggacttttcataacacctattcgggaacaccgcagggtggcattatcagtcctattcttgcaaacatttatttggataaatttgataagtatgtaaatgagtatgtccgaaaatttaaaaaaggtaaaaagcgtatgcgtacaaaagagtaccgcaggaacgaagtcgaattaagcaaagccagaatcgcattgaaaaatgcaaacgacgactgtgaaagagaaaatgcgattgcacgcataaggcagttggaaaaagaacgggtgaatattcccccaagtgaccctatggataacaattatgcaaggctggtctatgtcagatatgctgatgattggctgtgcggagttatcggttcgaaagaggattgtaagaaaataaaagaagattttaagaattttctcaaagaacaattacagttggagctatcagaagagaaaacgctgattaccaatgcccaaaaaagtgcgaaatttctcagttatgaaatcagagtacggcatagcaatctaaccaagagagataaaacaggcaagctcgttcgtaattacacgggcagaattgtactggaagtttcaagtgatacaatcaggaaacacttgattgatacaggtgctatgaagttaatctaccataatggaaaagaaatttggaaacccaaggcaatatacagattgaaaaactgtgatgatctggaaatactcgactactacaacagtatgatacgaggtttttacaattattactgtatagccaataacagctcaatcatcaacagctacaagtatattatggaatacagtatgtacaaaacctacggcacaaaatacagaacatcaatttcaaaagtaatcggaaaattcagagcaggaaaagattttgctgtaaagttccgtaattccaaaggagttgagaaaatgcgagtgttttataacgagggttttaaacggcagaaaaaagcattccaatctaatgcagacttagttccaaatacaatcaaatatttcagcagtacaaagctaatcgacagaataaaagccagagaatgtgagctatgcggaaaaactaatactcccatagaaattcatcatgttcatcggcttaaagatttacaaggtaaaactttttgggaagctcttatgatagcgagaaatcgcaaaacaatagctttgtgtagagaatgtcataagaaattacactgtggacagttaaattgagtttataaatggagagccgtatacagtgagagttgtaagtacggttcgggggcgagtatttggaaacctaccatagcaatatggcaaggcgctgggtacttagcctacgtgcgcccgtaaaggcatcataataaatatacctttggcaaggtattaggatagtatcttacagtcctatcatcaaccgatttacctgtgagggaaactaaatatcagggaaaatagcacgtcggtaaagccataagtcagctaattaccaagctgcgactgaatggggagatgaaaagttaggtatgaggataaagcccatactggttgaacgatagtccaaacggtcaatgtcgggactatggcgtaaggtaattattattcgccatatctcagcacttatgttccgctgttcaggagcgtaagcaaagataggctgagacgtatatgcaataagcataaaaggatggaagtcgtatccgacaacctaacaagccaaatcgttagtatgatgctaaacggggattacctaagtcgaaacgcttaaaaataagctattaagtgtaggcttatgaatattcgatatggtaacggagccttcatagtagtccgagagtgttaatggcacttacatggcgaaggaaggcagtttataacattaacaatatagaaaggataatgtgtgatacattatgagaaatcctgaaaatgtgttaatcagcttaacgaaacacagtaaccaaaaagattacaagtacgagcgtttataccgtttgctctacaatgaggaactgtacttaaccgcttatcaaaacatttattccaatgacggaagtatgacaaaaggtactgacaagcaaacggttgacggtatgagtatcgaaagaatacggaaaatcatagtttcgctcaaagatgaaagctatcagccaaaacctgcaagaagaacctatattccaaagaagaacggaaaaatgcgtccactcggaataccgtcctttgaggataaattgcttcaagaggttatcagaatgattttagaagctatctatgaggggcattttgaaaatacttctcatgggttcagacctaatagaagctgtcatacggcactcaatgaaattcaaaaaactttcacgggtgtgaaatggtttatcgaaggagacattaaaggtttttttgataacatcaaccatgctacgttgattggaattttacgagaacgtatcaatgacgagagatttcttcgactggtaagaaaatttctgaatgcaggctatattgagaattggacttttcataacacctattcgggaacaccgcagggtggcattatcagtcctattcttgcaaacatttatttggataaatttgataagtatgtaaatgagtatgtccgaaaatttaaaaaaggtaaaaagcgtatgcgtacaaaagagtaccgcaggaacgaagtcgaattaagcaaagccagaatcgcattgaaaaatgcaaacgacgactgtgaaagagaaaatgcgattgcacgcataaggcagttggaaaaagaacgggtgaatattcccccaagtgaccctatggataacaattatgcaaggctggtctatgtcagatatgctgatgattggctgtgcggagttatcggttcgaaagaggattgtaagaaaataaaagaagattttaagaattttctcaaagaacaattacagttggagctatcagaagagaaaacgctgattaccaatgcccaaaaaagtgcgaaatttctcagttatgaaatcagagtacggcatagcaatctaaccaagagagataaaacaggcaagctcgttcgtaattacacgggcagaattgtactggaagtttcaagtgatacaatcaggaaacacttgattgatacaggtgctatgaagttaatctaccataatggaaaagaaatttggaaacccaaggcaatatacagattgaaaaactgtgatgatctggaaatactcgactactacaacagtatgatacgaggtttttacaattattactgtatagccaataacagctcaatcatcaacagctacaagtatattatggaatacagtatgtacaaaacctacggcacaaaatacagaacatcaatttcaaaagtaatcggaaaattcagagcaggaaaagattttgctgtaaagttccgtaattccaaaggagttgagaaaatgcgagtgttttataacgagggttttaaacggcagaaaaaagcattccaatctaatgcagacttagttccaaatacaatcaaatatttcagcagtacaaagctaatcgacagaataaaagccagagaatgtgagctatgcggaaaaactaatactcccatagaaattcatcatgttcatcggcttaaagatttacaaggtaaaactttttgggaagctcttatgatagcgagaaatcgcaaaacaatagctttgtgtagagaatgtcataagaaattacactgtggacagttaaattgagtttataaatggagagccgtatacagtgagagttgtaagtacggttcgggggcgagtatttggaaacctaccatagcaatatggcaaggcgctgggtacttagcctacagagggaaggacgtattatccgtcagggaaaccataataaaaaggttcatatcttccggtatgtaacagaatccactttcgacagttatatgtggcagttgatcgagaacaagcagaaattcatttcccagattatgacgagcaaagcaccggtcagaagtcgtgaagatgtggacgaagcggcgctgtcctatgcagaggtcaaagcacttgcaaccggaaatccggcagtaaaagagaagatggcattagatgtggatgtggcaaaattaaagcttttaaaagctaatcacatgaataaccagtaccgcctggaagatgacattgcaaggaattttccgcaacagattgcaaaactgacggagattattgccagctacaaggcagataaaggaagtactgttgatcgtatttcggtagaggagtttccaaattacactattcccgtgatttcattgaagaatcagaaaaaaatggttgcagtattagaaaaaatcgacgctaagataaggactaataataagataaatgattatttatcatatcaatcttcgatggcagcttgaccattcatgagcattggaagtaaccagtctcttattgaggctaattcatcactttctttctgatattgttcttgaagcatgagcaaacaattaaacttgtttaaaatagctttattatcaggaataaaaactggaatattttcaatatctcctttggtaatgaattttacaatcgaacctgaagctgcagatttaaatgactttatttgatacatgcttgctaaatacagaagagcataatactctaggtctggtattaacacatatgttctttgataagcattaaattttcctgtataatgcttaacattaaactctccattgccggctatcaaaatagatgaagcattgaacgcatattcatcacatttcaatgtattacttgagcaagtaaagaaattatatttcccatttggtgatgaaaaatttgcatcttccttcccagtaacaatattggtcaaagcagatgcaattgtattatgaccagtaatattcccagtttgagcatcattcatcatattttcatacaacaagcaaagtagctgttctaaataatcatttaaagtggaatggagaagatagatacgatcgagaaatttctattgtaaaagagtcatgaccaaagagaaatatctaaattatatagatagccttgttatccagtaattcaaggagaacgaatcaactatcaaaataaataatgttttgaatacggggatgaagtagaaaggaaagtaccatgacaaaggatgaagtaaaaaaactctggatggacagtccggaatcactacagtttttaaataatgctacaaaattttataatttaatgatgatgtatcgttgtgctattcgggagatacaaactaaacttgaggttttggatgatgaattttcagttgagaacaatcgaaatcctatttcttttataaaaacaaggattaagaagcccaatagtatttacaataaattgcagaaaatgggacatgattttacaacagaaaatatacagacatatttaaatgatgtagcaggcgttcgaatagtttgtgcgtttattgacgatatttatatgatatcagatttgattacccaacaggatgatattaaagttattgaaataaaagattatataaaaaatccaaaaccaaatggttatcgaagctatcatatgattgttgaaataccagtattttttgctaagggtaaaacacctatgcgtgtagaattacagatccgaaccaatggtatggatttctgggcaacattggaacatcaacttcgctataaaaaaggaattgaagaaatgcctggttatgatgagataagtgaagaattacttcattctgcaagagctatcattgaagcggataatgaaatgcagagaataaaagacaaaattggtatgtttcatgaaatttaggcagaaaactgagcaagtaggaaggtggaatatatatgaagcaagatactttagagggcaaagcaaaaacaaaaaatggggtaaaacggctgtgtttttccatagtctgcattcttctggaagtaatttttattattactatcgtaacacgcttgaatgaatatgcagaaattataaatttatttacaaggattttgagtggaatcttggttttgggattgtacgcatcagataagacctcttctatgaaaatgccttgggtcatcttaattctaatcttcccaattatgggtgtaggcctgtatttgttgattggtttgaatggtggcacacataaaatgcgtgaacgatatacagaaattgatagtaaattattaccaatgcttcctgacaatcaggagtgtttgagtagaataaaagaaacgattccgaaagcaggaaatatcgcaagttacatacaaagaaattcgcagtatccaatctatcagaatacagatattgtgtattttgatgaagcagtgacaggattagaggcacagcttaaggatttgaagaaagcacagaaatttatcttcatggaatatcatgcgatagaagacgctgaagcatggcataagattcaagatgttctggaagagcgagtaaaagcaggtgtggaagttagagtattctatgatgatatgggttctataggctttattaatacagattttgtgaaaaaaatggagcgaataggaattcattgccgtgtattcaatccgtttatgccaggtttaaatctgtttttgaacaaccgtgatcatagaaaaataacagttattgatggaaaagtcggatttacaggtggatataatctcgcaaatgaatattttaattacacacacccgtacggacagtggaaagatacaggtattcgtttagaaggagatgctgttcagtcgcttacggtgacatttttggagatgtggaatgcagtaagtgataaggatgctaatgattctgattttagtaaataccttttccattatgattatgcggcacagcaaactgggtttgttcaaccttatgcagacagtcctatggataatgagcaggtaggagaagaagtttatatcagtatgataaataaagctgaaaaatactgttggtttatgactccatatctaatcataacagatgaaatgacacatgcgttatgcctggctgctaagcgaggggtagatgtaagaattatcacaccgggtatccctgataagaagttcatttataatataactcgttctttttatcatggattagttaaacatggtgttcgtgtttatgagtggactcctggtttctgtcatgcaaaaatgagtgtggcagatgattgtatggcaacctgtggaacaattaatctggattatcgaagtttatatcaccattttgaaaacggctgttttatggcagattgtcaggcagttgtggaaataaaaaatgatttgataagaacgatgggagaatgtcgtgatgtgacagaacaatatcaaaccggacgaagtgcatatttgagactgggacaattatttatgagattatttgctggattgctataagaatctgatgaaacgacctttcaaaaaacagttgatttagaagttaactgtttttgaaaggccgtttttgttatatctaacagtctgttgtacaaagaagattttgcatggatgaaaaaacaaaccttgttgaggttaaattgagttttccattgtattgtatgtgtttcttttaatcgtaataatggcaggtaaggagctgtatatggtagtcagtggatgtcttgtgatacgaaagacaggaaaagtacatggtgcagactggcatggaaagatagtaacctttttattatatggaactgcagcggtgcatattatatggttccacattacacctatggtatcagatctgttgattggtttgtgcgctataatgatggtcatatcggtcgctctgtatattatccaaaataccaggactcttaagggagagactgtataagcaattttatattgcaatgactagaaaaatatttaggagaagatagatataaacagtaagtcaaacacacaaactatggagtctttagtcggtttaataaaattttagatagaaaataaatcattcaatgtcatttagataaggttttttatgacaaaaagacagattgcatatctgcctcataatgcagtataatggtaacgagatttatgtaacccgatacatgaaatccctatttctctttggactgaggtggataggatattttcgattgtacctgacaggtgtcagatacttttgtatgagaagcatggtctctgtttcatcaccgccgtgtttgagatatgccctgcatatgtttactgcatttgaaatggatttactctgcatctggagcataaactgaatatactcgcggaaagaaagtttgcggttcctggtaaaatcactttccggattacggcagaacatggagtgaatttcatcgagttctgtgatgcagttgtcgagtgtggattttaaattagataagaaaaaatcagccataatgagcctccttgaaatatgtttataatcaaggcttgcgcaacatatattggcttacttgtcaactgttttttgtaatatttttaaagtttttaggcataaaaacagtggctttctatgacagaaaaccactaaaatgatgcttaactgaatggcattgctttataatcactttgaaaatggttgttttatggcggatagtcagacagttttggatataagagatgatcttggagcaacaatgaatgaatgcagggaagtgaccgaaaagtaccgcacaggacggagtgcatatttacggatcggacagttgtttatgagattgtttgcaggactattatagcagaaagaagaggtgttcgatatgtgtacagcagcaacttacaaaacaaaagatttttatatgggtagaacgcttgattatgaattttcctatggggaacagattacgataacgccaagaaattacgaatttgatttccggtttgccgggaagataaaaagccattatgctttgatcggaatggcatttgttgcaggaggttatccgctttattatgatgctgttaatgaaaaaggccttggaatggcaggtcttaattttgtcggcaatgcggcatatgaagaggctttgccggaagatgaaacagaagtcagccaggtggcacagttcgagttcatcccatggatccttacacagtgtgctactgtagcagaggcgagagagaagctggcagcaatgagactgacaggcacagcattcagtgaacagctgccgacagcacagcttcactggatcattgcagacaaagacgcctgtatcgttgttgagtctatgaaggatgggctgcatgtatatgataatccggtaggagtgcttaccaataatccaccattcctgggtcagatgtttgcactgaataattatgccggagtatccagaaaacagccggagagtacttttgcaggagtattacagcttgatgcatatagcagaggaatgggtggaatgggaatacctggagatctttccagccagtcaagatttgtgaaagttgcctttacaaaattaaattcgatctccggtgaagaagagggtgagagtgtaagccagttcttccatatcttaggatctgtagatcagcagcgtggatgttgtgaggtgacagaaggcaaatatgagatcacgatatacacgtcctgttgtaatacagcaaaaggtatttattattatacgacttatgataatcatcagatcacagcgattgacatgcatgcggaaaatctggattcagatcagctgatctgttatccgcttctgtccaagggcgaagtcagatggcagaataaataatacgaaaatgcacggagaaagcatatcgcagaacaacaggaggaaagaccatgaaagaagttaaaacaccgaaaaaaccactggcatattattatgggattgtgttaatagtgctgatcgtatttaatctggttgtcacaccaatccttatggagcatcaggtaaaggaaacggattatggaacttttatgagcatgatcgagaagaagaatatcggtgaagtagaagttaaggacaatcagatcatctttacagataaagatcaaaaaaatatttataaaacaggtctgatgaacgatccgaacctgacggacaggctatatgaatgtggagcagtattcgcaaaagatatcgataagcagatgtcaccgatcatcagcttcctgctgaccggggttttgccattgatcctttttatcgcactgggaaattatatggcgaagaaactgatggagcatgccggaggaaaaaattcgatggcttttggaatgggaaaaagcaatgcgaagatttatgtgcaatccagtgagggaatccgtttttcagacgttgcaggagaagatgaggcgaaagaaaacctttcagagatcgttgattatcttcacaatccgaagaagtataccgatgtaggtgcgtctatgccaaaaggtgtccttcttgtaggacctccgggaactggtaaaacaatgcttgcaaaagcagttgcgggtgaatcaaatgtaccatttttctcaatgtccggatcagaattcgtagagatgtttgtcggtatgggagcttccaaggttcgagatcttttcagacaggcaaaggaaaaggcaccatgtatcgtgtttattgatgaaattgatgccattggtaaaaagcgtgacggacaaatgggcggaaatgatgagagggagcagaccttaaatcagcttcttacagagatggatggatttgaaggaaataatggtgtcatcattcttgctgcaacgaaccgtccggagtcgttagatccggcacttacacgtccgggacgttttgacaggcgtgtgccggttgaactgccggatcttgcaggacgtgaagcaattttaaaggttcatgcaaagaagataaaagcatctgatgatgttgacctgcatacgattgcacgtatggcatccggtgcatccggtgcggagcttgccaatattataaatgaagcagcattacgtgctgtccgtagtggaaggaccgttgtaaatgaatctgatctcgaagaaagtatagaagtggttattgcaggatatcagaagaagaatgcggttctttcagatcaggagaagaaggttgttgcatatcatgagataggacacgctctggtagctgcattgcagagtcattcagcaccggtccagaagattacgatcatcccgcgtacctcaggtgcactcggctacactatgcaggttgagcagggtgataaatatctgatgacgaaaaaagaacttgagaataagattgttacatttacaggcggacgtgcggcagaggagatcgtatttggtgagatcacgacaggagcctccaatgatatcgaacaggcaacaaaaattgcaagagcgatgatcacccgctacggcatgacagatgaattcgacatggtggcaatggaaaccgtgaccaaccagtatcttggcggcgatacgtctctttcctgttccacagatacccagaaggaaattgatgaaaaagtcgtgcagctcgtaaaagcagagcatgaaaaagcaagaaaaatcctttccgaaaacagggaaaaactggacgaactggctatgtacctgtatgagaaggaaacaattacaggtgacgaatttatggatattttagacagaaaataatgtagttaattagataatcaatgtcatttagataaggttttttatgatgaaaacagtatatcatatgcgttcatgcattgaaaatactgttcagttaagaaatgctgtattttttaggtgcactaatgcgtagaaagcaggtgtatgatgagttcaaatcattttttgtgtatgacaaaaagacagattgcatatctgcctcataacgcagtataatggtaacgagatttatgcaacccgatacatgaaatccctatttctctttggactgaggtggataggatattttcgattgtacttgacaggtgtcagatacttttgtatgagaagcatggtctctgtttcatcaccgccgtgtttgagatatgccctgcatatgtttactgcggtggcgaaattaattttatagacgtgtttggtatttttagatgtttttaccacagcgtgagaagtcactaattcacagaaattatacagaatcatacgagcattgatttccccaattaatactaaattgactactccagcatcacctattgatcatatctttattaaaggatttataaaaaatacatgtagagtgtcgcaaccaacagagtgttctgatcatttaattttatgggctgaagaaaaatagttagtagttctgaaaaatggaattattttatataaaggagcggacaaattctcatttacagggagcggaagattgagctggataaaatacccagctcaatcttccacatggaatacatcttccaccagcatattaagggtgatagggtagagcaataaaacagattagatggaaagggaagaggcaccgttacataggtacctcttctttttaaagagttggctctttccctgatacaggaatttgtatctccggagcattgagcagtgctgtgaaattctgctgaatgatttccagagttttcagctttttctgtaattcctgtttttcccgaacagtagaagtctgttcagattcaagattttcaatctgcttctggattttattagagcttgggattttggtaataccgagatcctgaagctctttttttagtgaatcgtggagctggtattctgcctgatgtttggtgcggtatacttttgggtttttggcagatttgcaatcttcaatcactttacggcagagtcggtaagaatcgcagtgcttttgaatgattttctgtgtgctcagcgcactgttaatttgtattattctctgttcagccgctttaacagaagcatcaacgtcagaaatatgctgctggaaatcttcataattcagcagattattttcggaaagatagttgaaggtgcgggctgtctcttttagattatttagttttgcccaacgttcaaatccttctcgattgccggttgtaacatacgtgccgtgacatttctattaagatcaggagtaatcttgagattaagagggaaaaaggggaatgcgtgactccgtttgtagcatttggatacaggaagacaaagacagataagcataaattagagattgacccatctgcaggcagtgtagtacaggatatttttaagatgaagctacggggaatgagtcaggatgcgatcgctaatcgtttaaatgaactgggtattctttcaccatttgaatataaaatcagcagcggcagtcattatgaaactggcttcctgcagaaagagcaggcactttggagttctgttacagtccgtaggatactggaaaacgaggtttatatcggaaatcttgtgcagggaaaaaggacaacaccgaaccataaagtgaagcagacttatgtgaaaccggaagatgactggatccggattgagaaaaatcatgagccactggtgagtgaccgtgattttgaaattattcagagacttctgggcatggatacacgtacttcacctgaccaaaagcaggtatccaaaacttcttttatcagtaaaagaagcctgcaagttaacaggagtgtccgaaaaaacaatgcgttctttagcttatgagcaaaaaatgatggtgcgaataggaaaaagaactttaattcacaaaaaaaaattagaaaaatggattgactatcaagtgcggcattgagtattttatcctatagtacccaaaaagagcttcttgaaaagctcattaaaatttgatactattaaacggatgaagtacctgtccatgggtcaagaaaagacaggtgatcgtcatgggaaaagatctaacaggcaaagaattaggaaaagggtttacccaacgaaaagatgggcgttatcaaacacgcatatcacttggaggaggaaagaaaccgatatgcctatatggtcatactttaaaagaagttaaaaagaaaagggaaaattattagaaaaaacaaaatacggattagatatagacacacacaaaataactctaaatcagtggtttaaaaaatggatggaactctatatcgtaaataggataaaaaaaacaacaattcggaattatatcgattcgtataatcggtgtataaaatatataggctatatgaaattagcagatattcaaatcacgcatgttcaaaatatggttattgaactagctaacaaaggctataaaaaatccactatccgttctactgtttctgtcgtatccagctgtcttgaaagagctgtaatcggaaaaatgcttttattcaatccatgcagagggattgtttatccggaaataacgaataaaaacttcaaaccggtcaaaatggcaggacagaatttgaaacgcatgacaaacgacgaaatcataaggttttttgatgtagcaagagatactcgatattacgaattatatatactgcttctttttacaggaatgcggattggagaggcgtgtgcattggaatggaaagatgttgactttcaaaacaactatctccatgtgtataaaacaatcaatattgtccctgtttattacgatgacaacgggaacaaactagatagaccttattacatcaagcaaattacatctccaaaaagaaccgcaagtataagaaaaatccctctattcaaggcggcagttgatgcgttatatagttggcgcgaaaaacagcttgctgacaaaagaaagtacaaaaaaagtgggggattaaaaatttgttattaaatgattatcctcaattgatttttacgacacaagagggaaattgttttatgccgacacaggcagaaaaagagtgccgacggataacttccataatgaataatcatgaaaaacaacaggcactaacagaaaatagggaatatcatatttccaatattcatcctcatttattccgccatacgtttattacattgtgttatgaatttcatatggatccagcgtctataatgcttatttccggacataatgatattgatatgatgaaacattatacacatccggactccgtatttattaacagcgagtttaataaatatacagattatatgcataaatatttattccgttcaaatgcaacaattgatcaggatttacaaatttggtcaaaagatggtcaaattagcataccacaaacgctgaaacccttataaaataaggagattttgatatgagtaatgaattaacaccgatgatgaagcaatatatgcagacaaaagaggaatacaaggattgtatccttttttaccgcttaggagatttttatgaaatgttcttcgacgatgctctcacagcatcaaaagagctggaaattactctgactggaaagaattgcggactggaagaacgggcaccgatgtgcggaatcccgtaccatgcagttgacagttatctgaaccgtctggtatcaaaaggctataaggtagcaatctgtgagcaggtagaagatccgaaaacagcaaaaggaattgtaaaacgggaagttatccgtgtagtaacacctggaaccaacctggatactcagggactggatgaaacaaagaacaattacattatgtgtattgtctatatggcagaccggtacggactttcggttgcggatgttacaaccggggaatatctggtgacagaactggattcccagacaaaactgatggatgagctttacaaatttatgccgtctgagattgtctgcaatgaagcattttacatgagtggactggatttggatgatctgaaaaaccgtctgcatatggcaatttattcactggaagcatggtattttgatgatgcactctgccgggaaactttgcaggagcattttaaggtggcttctcttgaaggaattggactttcggactatgaatgtgggatgatcgcgtccggtgcgcttttaaaatatctggaagagacgcagaagaattccctgtctcatatgagccgtctgacacgttatgcaacgggtaattatatggttctggacagtgctacaaggcgtaatctggagttggttgagactttgcgtgaaaagcagaaaagaggatctcttctgtgggtactggataagacaaagacggcaatgggggcgagaacccttcggaaatatgtagaacagccgttgatcgacaagaaatccattgtcaaaaggctggatgcggttgcggaattgaaggacaatgctatttgcagagaagaaatccgggaatatttgaatccggtgtacgatctggagcgtctggtcgggaaaatcacctatcagtcagcaaatccaagagacctgattgcatttcagagttccctttccatgctcccgtcggtaaaatgtatattaaaggatatggagagtgaccttttaaaagaaatttatgaagaactggatccgctggaagaactttgtgatctggtcggacgggcgattcaggaagaaccgccacttgccatgaaagaaggcggaatcatcaaagacggttataatgaagaagtggatcgtcttcgaaaagcaaaatccgaaggaaagaactggcttgctgatctggagaccaaggaacgggaaaagaccgggattaaaaacctgcggatccgttataataaagtattcggttattatctggaagttaccaattcgttcaaagatctggttccggattattatacaagaaagcagacccttgccaatgcggagcgttatatcattccagaactgaaagagctggaagatacgattctgggagcagaggataaactctgtgcactggaatatgagctttactgtgaggtgagaaatactatcgcagcagagttgaccaggatacagagaacagcaaaggcagttgcaaagctggatgtgatagcatctcttgcactggttgccgagcgcaacaactatgtacggccaaagatcaatgaaaagggcgtgatcgacattcgtgatgggcgacatccggtggtggaaaagatgatcccgaatgatatgtttattgccaacgatacttatctggatgataaaaaacagcgcatttccatcattaccggaccaaacatggctggaaaatccacctatatgcgtcaggctgcgctgatcgtactgatggcacagctgggatcctttgtgccggcgtcttcagcaaatattggacttgtggaccgcatttttacccgtgtgggagcgtcagatgacctggcaagcggacagagcaccttcatggtggagatgaacgaagtggcaaatattctgcgaaacgcgacaagcaagagccttctgatcctggatgagatcggaagaggaaccagtacctttgatggattgagtattgcttgggcggttgtcgagtatatcagcaacagcaagcttcttggggcaaagaccttatttgcaacccactatcatgagcttaccgagctggaaggcaagattagcaatgtcaacaactattgtattgcggtcaaggaaaaaggtgatgatatcgtattcctgcgtaagatcgtaaagggtggagcagacaagagttatggtatccaggtcgcaaagcttgcaggagtgccgaatccggtcattaaccgcgccaaagagatcgtagaagagctggtgacagcggatattaccggaaaagtaaaggatattgcggtacagggaagtgagacgaagaaaaaaacgcagaagaagctggatgaggtggatctgacacagttttctctgtttgataccgtaaaagatgatgatgtgttaaatgagttaaaggaactggatatcagccatatgacgccaatggatgccatgaacaaactgtatcagctgcagaataagctgcggaacagatggtaggctgatccataagagaaaggaaagaagaatcgaatgccgcatatagaattgctggatcagattacaattgataagatagcagccggggaagtgattgaacgcccggcttctgttgtgaaagagctggtggaaaatgcgattgacgcaggatctacagcggtgactgtggagattgaagagggcgggatttctctgatacgaattacggataatggttgtgggatcgcgaaacaggacgtggaaaatgcatttctgcgccattcgaccagcaaaatccgcagtgcagaggatctgacacatttgtcttctcttgggttccgcggagaagcgttgtcgagtatttcggcagttgcaagagtggaactgatcacaaagacaagagaagatgtatttgggacaaaatatatcatagaaggcggaaaaggaagaacgccggaggagaccggagcgccggatgggacgacctttctggtgcgtcagctgtttttcaatacacctgccagacgcaaatttctgaagacgccgatgacagaggcaagccatatcagtgatctgctgaccagacttgccctttcgcatccggatatttccttccggtttatcaacaatggacaggtaaagctgcatacttccgggaacgggaagatgaaagatgtcatttaccacatttacggacgggaaattgcgaacaatctgatcccactggaatttgaaaaagatggtgtaaagctgtccggatatctgggaaagccagtgattaaccgtggaaatcgaaattttgaaaattattttgtcaacgggcgttatgtaaggaacagtattcttgcaaaagcgattgaagatggatacaaagattttacgatgcagcatcgttatccgtttgttgcattccagattgagatcaatccggaaaaaattgatgtaaatgtgcatccatccaagatggaacttaggttcagtaaccagcaggggatttacaatctgctttatgaggcgatcagtaaaggattgcatgagccggagttgattccggaagtggaaatgtctgcgatcaaagtaccgggaatgtctgaaaaaagacaggaaaagaaaactgttataagagatgcgggaaatccatatcggacagatggcacttcacccaagatgcgaaagagttccgttcaggagggggcagagcgagcggaatcctggtcgcagtcagagatgccgtcagcagaacttcagacacagataagtacagaaaagacagtctcaaccggtgacgaaaagctggattattttatgcagaagatgagggagcgggtttatgccagtcatcttacagaagcaaaagaagagcaagagaagaatatcggtgctaaagagtcaaagatggctgcattagatgaaaatccggctgtagatatccagaataaaggaatagaaaacagagcgtattcttataaaagtaaagaaaaaacagagcgtgatccggaaaaaacagagtcaaatctgtttttgaaggatttgaaagcaaaaaaagtaaaacagttagatttgtttgaagagcagattttaaagaaagaggcaagacaggaataccggatcatcggacaggtttttgaaacctactggctgatccagtatcgtgacagcctctatattatagaccagcatgccgcacatgaaagagtcctttatgaaagggcccttgcaggaatgaagaagagagagtatacttcacaatacttgagcccaccgatcatcctgagcctttctatgcaggagattgatgtgttggagacatttaaagaccgctttacggcaatcgggtttgaaattgagccatttggtggtgacgagtacgcagttcgcgcaattccggataatctgtttggaatcgccaaaaaggaactgcttcttgaaatgttggattccctgtcggatgggttatcgaccagtctggaaccagagctgattgatgagaagattgcgtccatgtcctgcaaggcagctgtcaaaggaaatatgaagctgtcctatgcagaaatggatgaactgatcaatgaactgttgtccctggataatccatatcattgtccgcatggcagaccaacgatcattgcgatgacaaagcgggaactggaaaagaaatttaagcgtattgtgtaggagaagaacatgacacagatgacagagaagaaaaagccactgatcatattgacaggtccgactgctgtcggaaagacggctgcgtcgattggccttgcaaaagcaattggaggagagatcatttcggcggattcgatgcaggtataccggcacatggatattggttccgcaaagattttgccggaagagatgaaaggtgtgaagcattatctgatcgatgtgcttaatccggaagaggaatttaatgtagctgtttttcagaagatggcaaaagatgcaatggtagagatctataagagaggacgtattccgattgttgtaggtggcacgggattttatatccaggcgcttttgtatgacattgattttgaaaagggagaagaaaacactgcctatcgaaagaagctggaaacgtatgcaaaggagcatggtgcgcaggcactccatgacaggctaagggaagcggatccaaagtcggcagatgcaattcatgcaaataatgtaaaacgggtgattcgtgctctggaatattatcatgagacaggaacaaagatttccgaacataatgaagcagaacgggagaaggattccccgtatcagtttgcgtattttgttctgaatgatgtgcgtagccgtttgtatgagcggattgatcgtcgtgtggatctgatggtggagcaggggcttgtagatgaggtgactgctttaaagaccagaggatgcacaagggaaatggtttcaatgcagggactcggatataaggaaattctggattatctggatggaaagaattcacttgaagaagcggtaacgatcctgaaaagggatacccgtcattttgcaaaacgtcagttgacctggttccgcagagagcgggatgtgaactggatccagaaagaggaattcggatacgatgaagagaagattttgcaggcaatgcttgcgatactgaaagaaaaggagattacagactaatggatatcagtcagaaaatacagaaattatatgaacagaccggaatttcaccggaagttcatgactttggagaaaaaattgaaaaatcactgaaagaacgttttgataagatcgataagatggcagagttgaaccagctgaaggtcattcatgccatgcaggaagcaagggtgaatgcagaatgctttaactatgcatctggctatggatacaatgatttcggaagagatacgctggaaaaggtgtatgcaaatgtctttcataccgaagatgcgctggtaagaccacagattacctgtggaacccatgcacttgctttaacactttctgcaaatttaagacctggtgatgaactgctttccatcgcaggaaagccttatgacacactggaagaggtcattggaatccgcccatccacaggttcccttgcagaatatggagtaatctataatcaggtggacctgctgccggacggaagctttgactttgattcgattgaaaaagcgattggcgagaaaacaaagctgatcacgattcagcgttccaaaggatatcagacaagaccgagtttttctgtggatcaaattggggaagcaattgcatttgtcaagaagatcaaaccggaagtcatctgtatggtggataactgctatggtgaattcgtagaagaaaaggagccaagtgatgtgggtgcggatctggttgtcggttccctgatcaagaatccgggcggcggacttgccccgatcggtggctatgtggctggaagaaaggatctgatcgagcagtgtgcttaccgccttacttctcctggacttggaaaagaagtgggtgcttcacttggtgtgatgcagtcgttttatcagggacttttccttgcaccgactgttgttgcaggtgcgttaaaaggtgctatttttgcggcgaatgtatatgaaaagcttggttatgcagttgtaccggacggaaaagaggaacgccacgatatcattcaggcggtaacactaggaagtgcggaaggtgtaatcgcattctgtcagggaatccaggcggcagcaccggttgacagttatgtaacaccggaaccgtgggcaatgccgggatatgacagtgatgtgattatggcggcaggggcatttgtacagggatcgtccatcgaactgagtgcagatggaccgatcaaagaaccgtatgcagtatattttcagggaggtctcacctgggcgcatgcaaaacttggtattttaatgtctcttcagaagttatatgaaaaaggaattgtaaaggaattatagaatgaaaaaaagagtcatcatcatcggcggcggagcagctggcagtatggctgcacttacggcggcgcagaacggcgcagatgtactgcttctggaacagaatgaaataattggcagaaaaatactgtcgacgggtaatggcagatgtaactttaccaatcgttttcaggattcatcctgctatcgaagtgacaatagcggatttgcatggaaatcaatcggaaaattttctgagcctgagacaacgtctttttttaaaaatcttggaatttatccgaaggataaaaatggctatctgtatccctggtccgagcaagcctcggcagtgagggaagcgctggagtctgcgctgaaactggcaaagatccggattcataccggagttcgcgtatttgggatcataccaaagaaaaatggttttcagatcagtttttcaaaagatgggaaaaaaggaatgatttccggtgaggctgtgatccttgcggccggatcaaaggcagctgcaaagctagggagtgacggaagtggatatgacctggcaaaaatgctgggacataagctggttccggttgtcccggctctggtacagctccggtgcagggaaaagctgtaccggcaagtcgcaggcgtgcgtattcatggaaaagtaacggtttttatcgataggacagaaacggcttctgatatcggtgagctgcagcttacggattatggtatttccgggatcccggtctttcagatcagccgttatgcggcgagaggtctgtatgaaaagaaagaagtttttgcagaactggattttatgccggattttggagatgtagaatttttgcagatgttaaaggaacggaagataaggctggatggtcttgtgatggaacagtattttaatgggttattccacaaaaagcttgccggtgcgctgcttaagagaattggaatttcgggaacaatgccggtgcatgaccttggtgaagagaatctggaaagactttgccggatctgtaagcatttccggacttatattgataagacaaatccgtttgaacaggcgcagatctgtgcgggtggtgtagatacaagcgaaattgatccggacacgatggagtcgaagcttgtaaaaggactttattttgcaggagaaattctggatgtagatggaatctgcggaggttacaatctgcagtgggcatggaccagtggttatctggcagggaaaggagcggcaaatgcttagaatcagtcagctgaagcttccggttacgcatacggaagaggatttgaagaaaaagattgtgcacacactgatgtgcaggacagaagcggtacagagctatgagattatcaagcagtctctggatgccagaaagaagccagagctgttctatgtctatactgtggatgtaaaagcggacaatgaaaaacagcttttgaagatgctcacccgaaaaaagcgtgcaggcaatgtgcaactccatgaagcaatgccatatgtttttccggcaggaggcaacgaaaaattgaagtcacgtccggtagttgtcggatgcggtcctgccggacttttctgtgcgtattttcttgcagaatatgggtatcagccggttcttctggaacagggggcaccggtggaagaacgacagaaagatgttgaggagttctggaagacgggggtactgaaaccggattctaatgtgcagtttggagaaggcggagcagggacgttttcagacggaaaactaaatacactgatcaaggatccggtggggcgcaatcgtaaggtgctggagattttcgtggaaaacggagcaccaaaagacattctttatgtgaataaaccacacattggaacggatattctacggactgtgatcagaaatatgcgtgagaaaatccttgtgtggggtggtgaaatccatttccatacacagatgacagaggtcctttttacagaaaatacaaggcggatcagagggatcgtatatgaagatcttctgaaaaaagaaaaagaagaaatacagacggagacgctggttctggcaccgggacacagtgcgcgggagacctttgcgatgctcttcgagaaaaaggttccgatggaggcaaaatcctttgcggttggtgtacgtgcagaacacccgcaggagctgatcaatcattcccagtatggggatgcaaaggcatctcttccggcagcagcctataagctgactgcaaaactgccggatggaagaggtgtatattcgttctgtatgtgtccgggaggctatgtggttaatgcgtcttcggaggagggatatcttgcggtcaacggaatgagctatcatgcccgcgacagccacaatgccaacagcgcaatcgttgtgacggttacaccggaggattttgaaagcgaccatccgcttgccggaattgcattccagagaaaactggaaaaggcagcttacaaagcaggaaaagggaaaattccggtacagagatacggggatttttaccggagtgtgaccggaaaagaaaaggaaaagaccgaagcagaagtctggtatcagggacatgagccatgtatgaagggtgcgtatgaagagacagacctggcggggatttttccggcaaagatcagtagcgcgctggtggatgggatggaagattttaacaagaaaattcgaggtttttcgcatcctttttccattctttccggagtggagagcagaacctcttcgccggtacggatcgtaagagataatcattcgctggaaagcgtgattggaggactttatccttgcggagagggcgcaggatatgccggcgggattacgtcggcggcagcagacggtattaaaatcgcagaaaaaattcgacaaaaatatgcaccgtttttatagaaaacagctgtgttaagaaaaaaataatatttaaaaagtctatacacgttttttaaaatatgctaaaatgataccagtttgtgattcaaaagaggaggagtacagatgagaggagccggaagtaagaatgcctgggcgttgtttctgctgattttggcaggaattgttctgggtggctttatcggtgtgcttgcagaaggggttccagcacttagctggctttcttatggacagactttcggggtagagacaccgattgttttgaacctcggacttgtcgttattacgtttggtcttacgattaagatcacgatcgcaagcattattggagtgattatctccatattcatttatcgtttcttataggatgtataaagcatcccatatacaagggtggagagtctggtgtgaatcaacaaatcctgcaaaaggatgaatcaaaaaaataccattcgagaaatgttatcagaagagcggccatatgaaaaatgtgaacgctttggggcgggcagtttaacagatattgaattgctcgctgttttgttaaggactggaacaaagggagagagtgcactggatcttgccaggaagcttttttatcccggagaaggtacacagccacaagccaaagcccatcttcaaagctggacaaaagaagaactgctgaaaatcagtggaatcggaagagtaaaggctattcagatcttatgcctttgtgaactttccaagagaatgtcccagctttcagccagagaagatctggatttttcaagaccggatacaattgcagcatattatatggaagatatgcgctattacaggcaggagcatttgaaactgctgatgctgaatacgcgttccagactgatcggagaaagcgaaatttcgagagggacagtaaatatgtccgtaatttccccgagagagctttttatagaggcattgcaaaagaacgcagtctatattatattgttgcacaatcatccaagtggtgatccgatgccgagcagggaagatattcttgtgacacagcgaatccgggaggacggaagccttcttggaattgaacttctggatcatatcattattggtgataactgctatgtatcactcgcagagcagaagctgcttaaggaaaagtagtatggaaaggaactttagattatggcgcgaaatatttacggtcttgatctcgggacttatgagatcaaggtgtatgataaaaagcaggacagtacgtggaaagagaagaatgtaattgctattgtggacggaaaagagatcttggctgtcggcgatgaagcatatgcgatgttcgagagaacaccgggaaatattgaagtggtgtttccgatgaaagaaggtgtaatcagcagatttacggatatgcagtatcttcttcagaatctgctgaagaaagagcgccgttttacaagaggatcagaatatctgatcgcagtacctacggatgtcacagaagttgaaaaacgggcgttttttgatctggttgttcattcaacggcgaaagcaaaagaagtgagtattgtagaacgcggtgttgcgcagtgtatcggaatgggaattgatgtccggaagacaaaagggatgctgatcgttgattttggtgcggctacaaccgaattatctgtagtaggttcaggtggcatggtacttaataaaatgcttaagattggtggtatgacatttgatgtggcagttcagaatatggtccgccggaattatgattttctgatcggaagacagacagccgaggctctcagaaaacgttttggagtacttggcggaaacggaaaagcttccatggtggttgccggacgtaatctggttgttggtgtaccaagataccaggaaatcccaagcagtgcggtacgggctgcgatgaaagaatctctggaaacctgcacttcgcagattggtcagttgattgaacggaccccaccggaggtagcccgttcaatcagaaagaatggaatttgtctgacgggtggtgtttccaggctaccggggcttgaccggtacatagaagctgtgactggatatccggtgcatgtggctgctaagccggatctgtgtgcagtagaagggctgcgacggatgatcaattcaaaagaacttaaaaaactttcgtactcaatgttggatgaaaattataggtggataagatagatgaaaagaaagaatcaattttcaacatcaaataaatactggttgctgatccttgctatcatatgtattgtattgatgggactttccggatttgcagagtccgggaaaggaccgctttcctgggcagcaggttacacgatcgtgccgatgcagaaaggaatcaaccgtgtcgggatgtggatcggcgatgtttcagagaattttgcaacacttcaggaaataaaaaaagaaaacaaagaactgaaatcccgcctggaagagatgacgactgagaataaccgattgcagcagaattcagcaacgctggaaagatataaagaactatataagatggatcagaatacagcggattatccgaaagttgctgcgaatgtaatcgccagcgagaatagcaactggttttcgaaatttacgattgataagggaagcaatgatgggatcagggaagatatgaatgtcctatctggaaccggactggttgggatcgtcacagaagtcggaccgaactgggcaacagtaagttcgattatcgatgataaaaatgtaagtgccatgatcctgacaacctttgacaaatgtattgtaagcggagatctgcagacggtgcaggacggacttttaaaatttgaacagcttgccaataatgaaaatgaagtggcggtcggagaacaggttgtaacatcgaatatcagcagcaaatatctgcagggacttctggttggatatatttcagaggtaaatgtagattccaataacctgacaagatccggatatatcattcctgctacggattttaaggaattacaggaagttcttgttattacaacaacaaagcaggatctgatcgatggaaaaggtgaaagtggaagcgataatggaggcgaatagacatgaaaaagattaaaaggatcctgatctgtgctgtgttgatcactgtctgtttccttctggagacaacggtgtttcaaaagctggcgtttgcctcgattattccgaatctcctgattatcgtgacgtcctcatttggatttatgaggggacaaaaagaagggatgatcatcggctttttctgtggacttttaaaagatatactaggtggaaatctgcttggattttatgcgctgatctatatgctgatcggatatggcaacggatttttccagagagtattttatgacgaagacatcaaactcccgttggcacttattgccggcagcgagtttctatatggtatggtgatttatgtccttttattcatgttaaaaagtgatttccattttttgcattatctgagacatgtgatcatgccggaactggtttacacgattctggttacacttgttctgtatcagatcattctgcatattaaccgaagacttgaagaagaagaaaaaaggagtgctagcagatttgtttgatttattggatcgtctgaaaagatggtttatcgacttggtaaaatctagagtgtttgtgctgatgcttgtgtttattgtgctttctacaattttgatacagcgtgtgtttgttttacagatcgtaaacggacaggcatatctggatgactataagcttcagatccagaaaacaaaagaggtacagggaaccagaggtcgtatcctggaccggaacggagtggttctggcagataacaagctcgcatattccgtcacgattgaagacaacggtgactatgatacggttaaagagaaaaataaaatcatcaatgcaacaattgagaaagtgatcagtattgttgaatcgaatggagattctattgtcaatgatttcaaaattattctcaatgataatggagaatatgcttattccatgacaagcgaggtgcagcgtctgcggttccttgcggatgtgtttggaaaagcaaccattgataagctcagtaacaagcagaaggcatacagtgcggcagatctgatgcattatctctgtacagatgagacctatggttatggactggacgaacagaagctgtccaaagaagaaatcctgaagctggtaacaatccggtattctatgggactgaatcgctatcagaagtatgtggctacaacgattgcaagtgatgtcagtgaaagtacaacagctgctattatggaaaacctggatactcttcagggagttaatattgaagaggattcaatccgttattacccagacagcaaatattttgcgtctattcttggttatacgggtgtgatttcacaagatgaatatgatgcgttggatgaaaaggagcaggactcgtattctcttacagatgtggttggaaaagcagggctggagcagacactggataaaacacttcagggtgaaaaaggtgaaatcaaactttatgttaacagtgtgggaaaggtcattgagtccaagcaggggaaaaaggcaaaggcaggaaatgatgtctatctttctattgatgccaatctgcaaaaggcagcttatgatctcctggaagaaaagcttgccggaatcatcctttccaatctgactacgtctctgacctatgaccgtacacaggcagaagagggaagtgatgtgaagataccgattggtgatgtttacaatgcatttatttccaatgagatcctgaatgtgggacattttgaagctgcggatgccggggagactgagaaaagtgtgtatgcgtcattttcctccaaaaaggaggcagtgcttgcagatgtgatggcacagctgagtgattcaggtgcgccggcatataaagactgtgatgaggatatgcaggcatatctcagttatattatcagtactgtacttacccagaatgcagcaatcattcagaaagattcgattgataccaatgattctacctatattgcgtgggaaaatgatgagagcatcagtctctatacttatctgaattatgcgatctccaagaactggatcgatacatcaaaactgactgattatatgaacagtgacagtgagtattcggatcagaatgaagtatatcaggggattctggcgtatatcagtgcaaatcttcctaaggattccggatttgacaaactgatctacaagtatatgatacgcaatgaagaaatcacaggaagccagattggtatgatgctttatgagcagggaattctgaattatgatgcagatgtttataataagcttgcggatggtacaatgaccgcctatgatttcatgtattccaagattgaagatctggaaatcacaccgggacagcttggactggaaccatctaccggatcggtcgtagtaactgacacgaagaccggacagcttcttgcctgtgtatcctacccgggatatgataataaccggcttgcaaataccatggattcaggctattatacaaagcttttaaatgatcagtcagcaccgttatataataatgcgacgcaggagaagacggcaccgggatctacttacaaaccactggttgctgttgccggactgacagaagatgttattgataccagtacgtatatcagctgcggcggactctatgaaaaaatttcaccgagtccacgatgctggatttatccggggtcgcatggaagtctgaatgtgacgagtgcgatccagcattcctgtaatatgttcttctatgaagttggataccgtctgggacttacaaaccagatgctcagtaatgcaaagagcagcgagtcgggatattcttctgaccagggatgtgagacgcttctgaaatatgcgactatgtttggactgaaccagacaacaggaatcgaaattccggaatcgtcacctcaggtatctgatcaggactctgtacgttctgcaatcggtcagggtactaataactatacgacaactcagcttgcaagatatgttacagcaattgcaaacagaggaactgtttataatctttctcttctggatcatgtggaaaataaggatggtaaggtaacaaaaacttacgaaccgaatgtgctgaaccagatagagggtgtttccggaaatacatgggatgctgttcagtcgggaatgcgggcagttgttaccagcaacagtacatattcttcgctgggaaatattacaatgtcaggtaaaaccggtacggcacagcagagtactacacatccggatcacggtctgtttgttggctatgcgccaagtgacgatccggaagtcgcatttgcgatccgtatcaaaaatggttatgaatctttatatccgtcagagattggaagagacctgatgcgctattattatggagagacaagccgtgatgagctgatcacagggcatgcatcagcagcaggttcatcatcgacacatggagactagattgagggggatcacaggtatgaaacagaaagtcatcattaaaagtaataaatacggtctgattgttcatatggatcctgatgcagagtatacagagattctgaaggaattgagagaaaaatttaccgaatctgcccgctttttcaaagatgcgaccatggcggttacgtttgaagggcggattcttacaaaaccacaggaagaagaggtcattggtctgatcactgatgtcgctcatatccatattgtctgtatttttgatgctaatgaaaatacagaaagattatacaaaaaagtagtagaagactctcttaacagtttaaccagaaaagaaggtcagttctacaaaggtacgctcagacaaaggcaggtactggagacagaacagagtattattatacttggcgatgtagagtttggtgcaaccgtagtatccaagggcaatattgttgtgttgggtgcggtaaggggaacggtacatgccggggcaacaggagatcggaatgcgtttattacggcgttgtcgatgagaccgcatgtaatgaagattgcagatattgtatcaacacatacatatcttcaggacgaaaccgtaagaccaagtatcgcccgtcttgacggcaagcgcatttatatcgatccactggagaatttagagtggtaggaggatctgaaaaatgggtgaaattattgtagtgacatcgggaaaaggcggtgtcggaaaaacaacaacgacagcaaatataggtgccggactttcaaggctcgggaaaaaggtactggtgatcgatacggatctgggtcttcggaatctggatgttgtcatgggacttgaaaaccggatcgtatataatctggtcgacgtgatcgaaggtggctgccgtttgaagcaggcgatgatcagtgataagcgtcatgaaaatctgtatctgctgccatcggcacagacaaaggataagtcagcgatcacaccggagcagatgatcaagcttacaaatgagcttcgagatgaatttgattacgttttactggattgtccggcagggattgagcagggattccagaatgcgattgccggagctgacagagcatttgttgtgacaacgccagaagtatcctccattcgtgatgctgaccgcatcattgggctgctggagcagaatcacatgaaaaaactgaatcttattattaaccgtatcaggatggatatggtgaaaagaggagagatgatgtcagtagaagatgtgacagagattcttcctatcgatctgatcggagcaattccggatgatgaacaggtcgtgatcggaacgaaccagggagaggcggttgtagatatggattcgctggcaggaaaagcatataccaatatctgccggcgtataaccggtgaagaagtgctatttctcgatctggataaacaggaaagtttgttttacaaactttcccatatgtttaaaagaaattaggaggatgtatcatgcatgtatttgaaagaggtatgcaccattcatctgtccgcattgcaaaagaacgtttgaaaagccttcttgtttcggaccgggtgcagtgtcagccagatacttatgaacttttgtgcggagaattataccacacaatcggaaaatacatgaagataaccgaagataattttaaagtggaaataacacgttcacagattagaatcaacttgacaggagaaaaatcgtgagattaccaaaaaagacaaaaccttatcatttaaaagatgtgaaattcggtctggtcatttctgttattgctatatcgattattggagttatggtaatcggaagtgcaaagcaggcagtacagggaagacagatcataggacttgtcgccggagtgatcctgatgatcattctttcgatgatagactatgtatggcttctgaacttttactggattttatacgggatcaatatcattgcactggtatgtgtaaagctgtttggaaccaatgtaaatggtgcacagcggtggatcgatatcggagtgacgaattttcagccatcagagctcagcaaaatactggttgtcgtattctttgcaaaatttctgatgaatcatgaggatgatctgaacagtgctgcaaccatcctgaaagcagtaggactgattgcaccaacactgatcctgatcgttcttcagccagacctttcaacaaccttatccatagcgcttgttttttgtgctatgatgtatctggcgggactgagttatcgatttatcggaaccctgattgcgattctggttccggttacgattatttttatcagtattgttgtacagccaaatcagccatttctgcacgattatcagcaaaagcgtattctggcatggctggaaccgcagaaatatgcaagtgatgaagcttaccagcagaataatgcaattatggcgattggttccggacagcttaccggtaaaggactgaataataatacaaccacatccgtgaagaacggaaattttatttctgagccacagacagactttatttttgcaattgtaggtgaagaattaggttttgtgggttgctgtatcgtgattggtctgttattattgattgtagtacaatgcatattgataggactcagggcacaagatctggcggggcggattatttgctgcggtgtagccgcgcagataggatttcagtcgtttatcaatatcggcgtggcaacagggatcttaccaaatacaggaattccccttccgtttgttagttacggactgacttcgcttatcagcttatatatgggaattggcattgtattaaatatagggcttcagcctaaaaaatatcagtaaaaggagctgagaaaatgaatatcggacttattgcgcatgactctaagaaaacactgatgcagaatttctgtattgcatatcgtgggattttgagcaagcatgagttgtatgcgaccggtacaaccggccggctgatcgaagaagttactaatctttctattcacaaatatcttgcgggaccgctgggcggcaaacaacagctcggtgcgcagattgcacagaatggaattgatgctctgatctttcttcgggatccacagaatccaaagccacatgaaccggatgtaaatgatgtcattcgtctttgtgacatgcacaacatcccgatggctaccaatcttgcaacggcagaaatcattatactcgcattagacagaggagacttggattggcgtgagatgtataagtagagcaaaaagtgccgcactggtatgtgtggcatcgataagtctgtttacaggtggttgcatcggaggaaaaggagcaacacctgtgacagcatatgaacttaaaaattataatcaggatttataccagggaaagctttatgcagaggagctgtgtgtagcacaaaatgatgtggcgttagaaggctatacagaagatactgaattgcacagtgctgcattatttgatcttacaggagaacgtgtattatattcttacaaagcgcatgaacgactgtatcctgccagtacaaccaagatcatgacggcacttctcgctattgagaatgcaaatttggatgaccaggtgacgatcagtggaaacgcagatacatccagtttttcggcggatgcacaggtgtgcggccttgtgaaaggagaagtctggacactcagggatcttttgggagctcttcttttgtattctggaaatgatgcagcaactgcaatcgcggaatatgtaggtggatcagaagaagcgtttgttaatatgatgaaccacagagcccaggaattgatggcgaatgggactcattttatgaatccgcacggactgcatgatgacaatcattatacaacagcgtatgacctttatctgatatttaatgagtgcataaagcatgaagattttgtaaatatcatacagagtgaagcatataccgcatattatacagatgtggacggtaacagtcaggaggcgttgtttacaccgaccaatctctatgcgcagggagaggtggatgtgccggagaatgttacgatcgtaggtgggaagaccgggacaacggatgaagcaggatattgtctgattctgatggaaaaagattccagtgacaatccatacatatcgattgttatgggagcctcagaaaaaccggttctgtatgaggatatgacatcattgatcgaggcaatcccgtctggtcagcagtaaatgtggtgtgtgaatcttatcgtatacacaaaaaggggcatctcttgtctgggagcccctttctttttttcaagcatgtagaaaatacaccgagatggtatcaggtacattacctgggcgtattaagattcggacatggatccgattctaccaaaaagactgatcaggtagagtccacacagtccgacgatcgtgtagacgatacgtgagagccatgacatgtttccaaaaagccaggcaataagatccagacggaatataccgatcagaagccagttcacagcaccgatgatcacgacggtgagtgctgtattatcaaaccatttcatgtaaatatcctccttatacgattctatacggttagtatgtgttaaaactttgtgattattcataaatgagaggaaaaatatgttatattataaatattcggattacctgaaaaacaaatatggtgaaaaagtatacaagcttccggtgaaccttccggtcacatgtccgaaccgtcttgacggagatggatgtgcattctgtgccggtgcaggaaccggatttgaggcaatggcggctacagtttctgtcacagaacagttgacacggaccagacagatgattacaagaaaataccatgccaacaaatatattgcatattttcagaattttatataaacttgatatagaaaatccgattatccgcataaatacagcatttaagggctgttcatcacttgaaaaaataagtgttttaccacgaatttaccataattgaatatgagtcttgatatgacgaaatataaagggagattgcacgtataataaaaccgcgtatctccctttaacaaactatctaaagttttctacatttataactctggaaaaacaatcgcacaaattcatgttgtgagtgaccatgattatagtaatgcccttttcatttaattctttcaaaagtttcatcactatcaattcgttctctttatcaagtccagaagttggttcatcagctaatataatctgacttccttgcaaaatcaatttaataattgcaattcgctgttgctctccaccgcttaactgatatacttttttgttaagcatgtcacttagctcaaattgctttaaatacttattgattagtttcagtttttcttctttttttacttttttatattcaagagctaattttaaattccacaacacgctttcatcttctattagtccataattttgaaatagatagcctattgtatatcttctcaaaatcatagcatttttaccgttcatggacaaatttttatgactatcaatagtgattgttccctcggatatatcagtaatcaatcctattatatttaaaagtgtcgttttacctgccccgcttttccctacaagccccacaaattcgcctttttctatttctaaagataaattttcaaatagaacctgatttttcccatattcttttttgacgttctttaatgtaatcaatgacatacttatgcccccttttcaatctcatataaagcgtttgagatataaattctataaagcaattcgcagaatatgtagtcaataagtataatcgcaaaaaggcaagcaaaataataatttatagcagttaatacgcctgatataattatttcgattccccaaaaaatataccgatttttcagtgtcctaaaatgagagaatcctaaaatctcttttgccgcatatctctttcgatttacaaaaatgtccacataatttgaaatatacaaaataaacagtaaagacactataaagacaatcgtaaacatagtgagtgttttaagaacgaatgtcacattttcaagttgcattaaataaggtgtaagtaatgttccagctgtaactaattgctctaaatcatattctgataacaaagaagaaaaatcttctcttgactccatttgaaaaaataaacaccttgtatttaaagaatccaaatagtaaagtcctgcaaaattgcccgtatcaacaatgataacaggattagccatatccgaaaaaccattttctgtattgacttttatcgtagaatcatcgtctatataaacaacattaaatttatcaatagttttttcttctcccggtattccataaaattgattgtaattcatcaatcggaaatattcttgcttaatatattcgctaatagaattttcatcattcttatatttatgtggaactaatactgttggttcactaaatatatcttctcccaatggttttccactgagctggatatttgaaaattcattcagataatttctatttgcaataacaagctgttgttcataataggggcgtgatgtctgcaaaccaccgtctgtcctaaaatcacatagtagtgaatggttatgattatacatctctaatgtttgttcagaatatttttctaatatgtctgtgtttgctaacgcataatcatactccgatgaattaaaaccattagcggtataatatccgtccagatacttataatctaaaacagcttgttggctttgtctaaatgagttcccctgattcagcaatgaaataatagtgatagcgattattaccgaaaaaattatttttatagcctgaactacaatatttgtgccgctatttaaagtcttattttttatcattgcctctaaagaaacaaacttaattaaaatacttgtaattaaaacacaaagtatatttatagctaaaacaccaataaagaacagtacacttgttgctaaataagaaaaatcatatctgtttgttaatgcgtaatataaatttagcaagaacagtaatactaaacatattacagcaaaatattttattacactggtaatttgctcctttaaaatatgtatagtagaaaagcccatgctttttttaatacctatttttttcaaactataagacgtataaatacagtatatgatttgaagtacaataaataagattacaaaattcagaagattcaattctaataccatactatacggaatagcgtcattttcaaagttatttattgcgacggacagttgagaagctatctctttaattgcgttagctggtaaatctgtatagaatacaccaacactatctaaaaaatcttccttttgcaattcatgatattgaaacaaaatagaggaagatataggctgtttttgtgtaaactcatttaatggatagcaatataaatcataaacagatttatctgtggaagtgagcgtattgttaatgagttctaatttattttgagaatattcttctgtaaatattgtataaaatttgtcgagaatttctggcgatgtttcttctaaaacatacccttttaaattctcagtagcaatgttattcttttcataaatgttgtaaatagaagtattaaaaatatatgcaaagagtatgacttcaaggaaaataaaaatctttaaaaattttttcataacatacgcccctttctttgaagaaatgtataaaatagggcgggacaaatagccacgccctaggtgtttgaactattttacttaatatggataataatcataataagatgtttcgttcgcccaccaaactctctttgcatctttgtaagcgtagtttgacttgaatccactggtatatgtatctccgccgacctttacagttgcctttaccatgtagttgcgactaatacctgctttacgcccaatttcggaatatacaatggtgtctgtttgccctccattgtagtacaaatctccacccgctacatcaatagcccacgctgtaagtggagcgccgacaaccataactgctgctacaagaccaactactttcgttctcaacttctttgctctctttcgataaacctcctttctcttttttactttttgatagttttatgtcacgtactgtttttactaacctcaacataacatatatttcattaaatgtcaagttatttttgtttctattttatatatgacctctttgttgctatcatattttgtgcataatgcacaaaatcaaagtgccaatattagtgctttccacgattgtacttttacaatgaaaagacgaagtacctgtgataaattcattgctctaaaattattagagaaactatacaatatagctatccttttttctcttgtctgccataaacagaaaagaaaaagccctgtcaagagcctgccacttctttagaagtggtgcttgcactcttgatctgggctttttgtttgctgtatctttttgcaagaggaaaaaggctactcgtccccgttgtcaaaatggctgtcctttaagacttcccgcaacagctccatatcttcttttgagttgggatttatcctctttacaacctgataaggtgtaccgtacttgtgtccgtctgtgctttccccgaacatatccatgctgtataaatcatcataacggtctaatactttctgaaatttcaagtgctggataaatgttttgatagggtaaaggtcggacgcttgtatgtcctctcccttgatatagtctgtgatgtatttccgcaactgctccaactcatactctagccattcttcttcactgtcaaagaagttatcatagtgtccgtgtttcagttctgcatttaggcgttcttccgtccgtaaaaacttgcatacctctttttccgcctgttggacaaacttccattctcccgacaacaattcattcggtgttacttccagtacgtccattatcttttccagcgtgtcaaaggtgggatagtttacccctcgttcaatcttagaaaggctctgcatattgataccgatggcgtccgcaagctcctgctgtttcattttcctgtgttttcttatggtctgtatgttctcccctaaaaaatttattttctttgtgtcatgctccataacttcttatatcttttcctttcccggctttttcgttcctttataagcctatcatacttattatagccgaaaaagtcaagaaaaagttcttgacaagtaattctaacggcgttattatcatggaggatatagtgattaagcacaatgaggtcaatcacacgcttgagtaggcatagaaaagagttattttcgctttgatagcatgaataggcatggactatccgaccgaaaacggtgtttcttcctgtgcctgccccgtttagccacgagcctcccaaaggctcgtgagcgttaagaacggggctggtgcaggaagaaaaggaacgccgtaggcgttccgtacagggcgtatatgtaacaccgccctgcgcatacatgtcatagtacctagaaactgtgataaataaaggacaaaacacgatttttaccccgcaaaaaaacggggagtacgaaaggagtaatgcactatcgcaacacatgaaaatttatccgtcaagattgattacatcagcattgtctttgatacggcaacggcagaagatgtgatacggcacattttatgcttgccgaccgatatttttaatgtctatcctgcaacggtcaaatttaagacgtatcaggcgcgttgggaaatcggagatatttatgtatcgggcgacgcaaaaaagacagaggacaacccacaagggctgggctgttatctcgtgatgacaggcagggggtgtgatgatattttccgtatcctcgataacaacggcttgacctttggggatatgttcggacgctgtgaaaggagatatggggctggaaactaccatttcacaaggctggacgttgccattgacgacaggaacgaaacgccgttctttaccatagagcagataaagaagaaatgtgaaaaagaggaatttatcgccaacagtgagggctaccattttgacgagagcaagtttgatgattttgacaccgcaaagaccgtctatatcggggctggaaaatcggggctttcctaccgcttttatgacaaggacaaggaagtgtgcggcaaatacaacaggacgcttgatgaagtcgggagttggaaacggacggaaatgcaactgcgtgatgaaaaggctcatgcctttgctatggcatttcaggcaagaccgctggagattggggaactggctttcggactgctggcggacaacctgcgttttgtcgtagcaaacaggaatgagagcaacaagagcaggtggaaaacgtgccgtttctggcaacgctttttaggggctgtggaacttttaaaactccatgtacccacaccgcataattcccttgaagaaacgcaacagtggcttacagagggtggtgtcatatccgctgtcaaaggcttttacttcctcgaatcccatgacgctttaggtgggctggaacgtgtcggggatatggtagataaggcaaggtacagcacttccctttccagcaagctgaccgcccatttacagcggatagacaggacagaattgataccctacgtccagtatgacacaaagaacaggtaggggggggtggcatgatgaacgaaaagattgatattcctgtatgggaaaaatacacccttaccattgaggaagcgtcaagatacttcacaatcggacagaacaagctacgccgattggtagaagaaaaccgacacggcgactggtatgtgatgaacggcaaccgtatcttgattaagaaaaaacagtttgagaaatttatggataaaacagacgcaatctaatgcaaaagagccttgtatgtgatattatttcagtaagtcatatcaaggctctttcttacgaaaggagcagataagaaatgtcggaaaaaagacgggacagtaaaggtcgcctcttaaagacaggagagagccagcgagcagacggaagatacttatacaaatatgtggacaaggcaggaaagacaaggtatgcctattcatggaaacttgtgccgacagacctcgtacctaaaggcaagagggacgggaaatccctaagggaattagaaacggagatacaaagggatttacaggacggtatcgacacaacaggcggaaaaatgacgctgtgccagctatacgccaaacagaacgcccagagagccaacgtaaaggaaagcacaagacagggcaggaaaaagctcatgcggacattagagggcgatatactgggggctaggagcattgacagcatacgcctttcagacgctaaggaatgggcgttacgcatgaaagacaagggctatgcttatcagaccataagcaattataaacgctcgttaaatgcgtcattccgcattgccatagcggacgacctcgtgaggaagaacccctttgatttcaagctgaatgaggtcatagaggacgacaggacaccacggcaggcattgaccgaggaacaggaagaaaggctcttgtcctttgccagcagggacagggtatataaaaagtattatgacgcaatcgtaatactgttaaagacagggcttcgtatctcggaactgtgcggactgacaaggcaggatatagactttgaaaacggcgttatccatgtagaccaccagctattatccagcaaggaaacgggctattatatcgaaacaccaaagacaaaaagcggtgtgcgtgatgttcccatgagtgaggaagtgaaacaggcatttgagcgtgtcatggcaaacaaggcaaaggcagagccgacagagatagacgggtacagtggtttcctctttctgaacgggaaaggctttcctatgacgaatgcctattatacttctactttcgctaatctgagaaagaaatataacaagagccatgaggacagcttaccaaagataacgccccatatcctgcgtcatacgttctgtaccagacttgcgaacaggaacatgaaccctaagagtttacagtatatcatgggacatgcaaacatcagtatcacgctgaacctgtacgcccatgcgtccatagagaacgtcaaggcagaattaagaagcatgatagcttaaagttttaccacgatatttaccacgattgaccgtgagaaaacgtgatgaaacgtagctgtttggaagtatcagccgaaaagagaaatgcccgtaaagctgataaaataaggctttgcggacatttaagaagatatgaaaagataatcaaaaatttatattaagtttataccaatacctttcttcctccggacagatttcgcagttatctgatggaggctaccaggattccgggtgtcgtggagatatctgtttccacaagaccggattgtgtttcggctgagtatcttgatattatgagagatatccgcgcgatgaccggaattcagatgaatgtagaacttggattacagacagcaaattatcatacactgcagatgatcgacaggggacatggtcttgcagaatttatcgatgcagtactgcggattaaaagatatactggtatttcaatctgtacccatgtgattcttaatcttccgggagatacggcagcggatgcaaaagagactgcaagaatccttactgcgcttggtgtggatattgtgaaactgcattcgctttatattgccagaaatacacggttgtgcgattggtatgaaaatggtaaaataacggtatgttcaaaggaagaatattttgaaagagtgattacgtttcttgaacagattccggaaaccgtggcagtagaacgaatgttttcaagaattcctgagaaagatgcggtgttctgtaactggggatgcagctggtggaggctgagggacgaactgctgcagaagatggaagaggaaggcaggtatcagggcaggtgctgtgattatctgaatggtgcggcactgtgcctgttaaaatccgaatagatttggaggcttgatttttggctgggaaaaagaagaatacggaggtcgtcagcctccagaaatataaacgaaaaggacatttaaatattggtacgattctgtttggaattatttttgtgtatcttgtttttaccgttctgatctattttacaaaagatagagtgagtgtatatgaggtacgggaaggaagcattttaaaagacaggaatcttaccggaatggttctcagaaaagaaacggtggtaaatgctgaaaaaagcggatatgtcaattattttgtagacgatgcacagaaggttgcacttggaaccaatatttacaccattacgtcttccaagctcgagacacagacggatcaggacagcaatgaagaagtttccctgaatgcagatgaatggaacagtattctgctgaaggcacagggatttaatgaatcctattcaccggaggagtttaagacggcatcaaatctgaaaagtgaagtaacagcgatcttacagaacaatacgacacagagcagggttgcacagctgaattctattctgcagtccggaaatgtagatgcatttcaaagcccggatgacggaatcgtggagctttcggtagatggctatgaaaatctgacgacagataatatcacggatgagatgtttgataaggcaaattacagtgtcacagagctttcaggcaatcagaagattgatgcagggcagccggtatatcgcctggtcacagatgaagagtggacggtaacggtacgcctgacctctgatctggcacaaaccttccagaaaaaaatgaacggggaagattccctttctgttgaggtcagattcctgaaggataataaggacctgtggggaactatgcgacttacggaaaagaaaaatgatatttatgccaatattacttttaaggattccatgatccggtatgcagatgaacggttcgtgaatattgaactgatcctggaagacgagtccgggcttaagattccgaaaacctcggtaacggagaaagactgttatgctgttccgatagattatattacgagcggcggggcttctcagaacgaaggtgtctacaggcagacgaccaaaaaaggaaagacgacaacggaatttattccggtgacgatcattaacgaggatacggaatcgggtattgcatatctggatacagagaatctgaaaaaaggagatactcttttgttgccggaatcttccgatacgatggatcttttgaaaaccgaaagcatcaaaggagtttataatgtcaataaaggctatgctgtattcaagcaggttcagatcctgagtgagagtgatgaatactatattattgcagaaggaaacagctacagtctatccaattatgatcatgttgccctgaacggagattctgttcgggataatcagatagtaagtcaataagaaatggagtgaaagaaatgatcacagaaaacttaaaagatgtggaagcacgtgtatgcgctgcatgcgaacgctccggcagaaaacgggaggatgtaacactgattgctgtcagcaagaccaaaccggtagaaatgctggaagaagcgtatgcttacggttgccgttattttggtgaaaataaagtgcaggaactggatgaaaaatatgacataatgccgaaggatattcactggcagatgattggtcatctgcagcgcaacaaagtaaaatatatcatcgataaggcagagctgatccattctgttgattctattcgtcttgcggaaacaattgataaagaagcagcgaaaaaaggtattgttgtaaatgtgcttctcgaagtaaacatggcaaaagaagatacaaaattcggtctgatgccagaggaagttatggattttattcatgaaattgtcagatttcaacacataaaagtacaaggattgatgacaattgctccgtttgtagaaaacccggaagaaaatcgtatacattttgcaaacttacgaaaattatctgttgacattgcaaaggaaaaagttgataatgttaacatgagtattctttcaatggggatgaccaatgattttgaagttgctatagaagagggagccaccatggttcggatagggacagcaatttttggcgagcgaaattatgctcatcagatttagataccacagataggagtgtataagaaaaatgggagtattagataagtttttagacgttatgaaattaaacggcgacgatgatgagtatgatgatgatttctacgatgaagatgacgattttgaagatgagtcatatgaagaagagaagccaaaaaagaatatttttggaaagaaagataaaccggctgcttacgaagaagaagaggaagattatcagcttaaaaaatcaggtcgttcaaataaagtcaccccgatgcgccagccttctacacgcagaaatgctcctgcaatggaagtttgtgtaatcaaaccaaacgcaatggatgatacacgtgagattacagagactcttctcgcgggaagaactgttattttgaatctggaaggtatggatcttgagatcgcgcagagaattattgatttcacatcaggatctgcttttgcaattgatggtaatcttcagaagatttcaagttatatttttctggtaacaccggcaaatgttgatatttccggcgatatgcaggatcttctgaatacttcgttcgatgtgccgatccagaaccgttactagaagaaagaagacagggtatggaaaaagaagagactttacttcgtaaacgtctgattgagctgtctaacaatgcttatcagagaggaatcattatgtattccgatttcctgaacctgaatgaactgaatatattacatactacgccgaaggattctttccctgttccatacaggacctttggcgggtatgatccgtcagagcgtcagatggcagcatttctacctgatgctttttatatgtatatggatgaggaaagtatccgcagtacatatccgatccgcattctgaagatcagtccgctgcagccgaaatttgctgaggaattatcacacagagattatctgggtgcacttctgaaccttgggatcacacgggcaaagacgggagatattctgattcacgataaggaagcttatgtttttgtacatcaggaactgacagagtttcttgtaaaagaactgaccagggtacgtcatacaaccgttcgtgccgtagaagtagaaaatgcagattttaaatgggagccaaagtacgaagagattaaggggactgttgcatcagtacgcctggattcccttctttccctggctttttcttcgtccagaagtaaacttactgcattgattgaggctgggcgtgtatatgtaaacggaaagctgattaccagtaatggatatcatgtaaaggataacgatatcatttccgtaagacagatgggacgttttcagtacgaaggagttctttccgagacaaaaaaaggacgttattatgttacaatccgaaagtatatctaatggcattagcagtaaaggagagcatatgaagaacagaccagggttaaaacaatatatttttgcagcacttggagtcgtaatcctggtgcttctggatcagtatacaaagcttctggcaattgcacatttgaaggatcagtctgcatttgtgttgtggaataatgtttttgaattgcattatcttgaaaacagaggagctgcatttgggatttttcagaaccagcgatggttctttgtcatcatgaccgttgtgatccttgttattgtgagctggttttatggcagaactccggtagaaaaaagatatctgccactcagaatctgtatgatcattctgacagccggagcaatcgggaattttattgaccgtctgaccagaggatatgtggttgactttttttatttttcactgattgattttccgattttcaatgtggcggatatttatgtgactgtgacgtttatcgttctggttctgctgatctttttttattataaggacgaagatttttctatttattcgcgcagacaggagcagaaacatgcagattaaagaatttcagagtgaagaaaatgcaggggagagaatcgacaaatttctcacagagaaagtgccggagctttcccgttcttatattcaaaaactgataaaagaaaaaaatgtaaaggtaaattccacagtaatcaaatctaactataaggttgcaaaaggagatcaaattcagattacgataccggatttgacggaaccggatatcctgccggaaaatataccattggatattctctatgaggatgatgatatcctggtggttaataagccgaaaggtatggtagtgcacccggcagcaggtcattataccggaaccctggtcaatgcgatcatgtatcattgcaaagaccggctttcaggaatcaacggtgtaatgcgtccgggaatcgtacaccggatcgatatggatactaccggttctcttctggtatgtaaaaatgataccgcacaccagatccttgcagaacagttaaaagagcacagcattaagcggatttatcatgcgattgtacacggtaatatcaaagaggattccggtactgtgaatgcgccgatcggacgccatccgattgaccggaagaaaatgagtatcaatgagaaaaatggcagaaatgcagtgacacactaccgggtcctggagcgttttggcgaatatacttatattgcctgtgagcttgaaaccggtcgcacacatcagatccgtgtgcatatggcaagtatccatcatccgttgcttggagactgtgtatatggtccggcaaaatgtccgtggacactacaggggcagacacttcatgcgaaaattcttggaattatccatccgagaaccggaaaatatatggaatttgatgccccacttccggaatattttgaaaatttattgaaaaaactacgcaaaatgtcatgaaaatctatacatttattatgaattgttatataatatgtataggataatcatggaataatgacctgcaaaggagcgtgacgtttatgagtaaaacacatacaattataacaataggtcgtcagtttggaagcggaggacgcgagattggaaaacgtctggcagatgaactgggaattgagttttatgataaagaattgttgtcacgggcagcaaaggacagtaagatatgcaaagagctttttgagacacatgatgaaaaaccgacgaacagttttctctattcattggtaatggatacatattctatgggatttgcatccggttctgtcaatgaaatgccactaaatcacaagattttccttgcgcagtttgatgcgatcaaaaagattgcggaggaagggccgtgtgtactggtaggaagatgtgcggattatgcactggaagagcgggatgatgtactaagtgtattcattcatgcagatctggaagataggattaaaaatgtagcaaagctgaatgaactgacagataacaaagcaaaagatctgatacataagacagataaacgcagggcaagctattacaattattataccaacaaaaaatggggcgatgccgaaagttatgatatttgtataaacagttccaagtttggtgttgacggatgtgtgaaagctatcaaagattttcttgaattagaggcaagcttggaagagtaagaacagcgattataatgttataagacgggggaaataaaaatcccccgttttttagacctgtagcaaaatacttatgttctgataatttcggaacacaggcattatagtgtcaaataaagagaagaaagaggagacaagaaaacatgaaatttgtaattcagagagtaacacatgccgaggttgcggtagaaggagaagtgatcggaaagattgggaaaggatttatggtgctgatcggagtggcacaggatgataccagggtgattgcagacaaaatggtaaagaagttgacaggacttcgcatttttgaagatgagaacggaaagaccaatcttgccctaaaggatgtggatggagaacttcttctgatttcccagtttaccttatatgcaaactgtaaaaaaggattccgcccaagttttattgaggcaggtgcaccggatatggcaaatgaactgtatgaatatattattgaagaatgtaagaaagtgatcccggttgtggaaagaggaaactttggcgcggatatgaaggtatctcttttaaatgacggtccatttacgatcgtgctggattcggagcagatttgttaaattattatttggtttctaaagatgtatcgtgtataataagatacagatggaatacacaagaaagtggggaatgtaataatgagttatgaagcattaaacagcaggattatggagatgaaggatgaaattcttgctggaatccaacagaacatgagaattgaaagcgtgcgtggtgaggcacagccagacgcgccatatggtccgggaccgaaggctgctctggaagatgcccttgaacttggccgcaagcttggcttcaaggttgggcaggcagacaatcgtataggctgggtagaatatggagaaggaaaagagatggtaggcgttcttggtcatgtagacgttgtaccggctggcgataccggttggacttatcctgcctatggtgccgagatccacgatggaattctttggggaagaggatgtctggatgataagggaccgatcattggatcaatttacgcattgaaggcgatccgtgacctgaatcttccaattgaccgtagaatccgtgttatttttggatctgatgaggaatgtggctcttcatgcgcggcgtattacgtagagaacggatatgagatgccgacgatcggatttactccggatgcagattttcctgttattttctgtgaaaaaggaacgaccggaatcaaaggcggttctaaggtttatgacaaaggtcatatcgaagtggaatattttggtggtggaattgctgacaatgtcgtgattccaacttgtaaactgatcgtaaaaggagacattaaggtagcagagacagaaggaatcactgtgacgcatgaaaacggaaaaacaatcgttgaagcggtgggaagaagtgcacatggaagtaccccgcatcttggtgtaaatgcagcaattcttcttttgaatgcagtgaaagagaatgaatttggtggagaattccagcaactgatggaatttcttctgaaagagatcggaacggagacaaatggagaatcactgggagtacattatgtggatgaagaaactggtgagacaaccgtaaaccttggtattgtttattatgatggagaagagacctattttacattagatgtccgttatccaaaaaatgcagatccgaaagttgttgatgatacactgatcaatcatatcaacagttacacattcgatgtgctccggaaaaataaccacaaaattctctatgtaccaaaagactctgaactggtgacaaagctcgttcatgtatatgaagaagagactggcgagcacttggaaccacttgcaatcggtggtggaacttacgcaaagaaattccagaacatggttgcattcggaccggtatttccaggtgaagcagacgtgatccatcagccagatgaacatgtggaagtagaaaagcttctccgtgcactgcagattacggcagcagcgatgtacgaacttgcaaaaaaatagtataaaacagtactgactgaattatctggatatgtcataatagatacgagcatcgaagggtgagttgttcaatggaacaaaagccggataagatgacaggttgagaatacctgtacatcttatccggcttttttgatgcatttgaaaaaatatttatgatagtaagaaaaaaagggatatggagaagaacatatataaaaaacaggtgattacttgcaaaaagcacttctatctgagatgcttctgcaagtaatcacctgtttttttaaaattaacggaagaagcgcataacagcagcaactttccctaaaatcgtaacatcttcaaggataaatggttccattgcatcattctccggctgaagacggatcacaccttcttctcggtaaaacgtctttaccgttgcaccgtcatcaatcagagcaacaaccatatcaccgttctctgcagttgcctgcttttccacaatgacataatctccatccagtataccggcatttatcatactttcaccctgaactttcagcataaagagttctttatttgatgaaatatattcagtaggaacaggatagtaatcttcaatattctcctgtgcaagaaccggttctcctgcagctacatggcctacgatcggaatctgaaccatctcacgtcttgtgagattaaatgaatcatccagaatctcgattgcacgtggtttggttgggtcacgtcgtatgtatccgttcttctcaagagtctcaagatgagagtgtacagaagaagttgacttcagattcacagcatcacagatctcacgtacagccggtggaaaaccacgttgcaggatctgggacttaatatattcaagtatctcttcctgtttcttgctaatattacctttactcataaaagacctcctaaatctgtatctatatcaatttgaattattatccgaactattaaaattatcatatcatacagaagaaaaaatagcaaacaaatgtttagaaaatacgttcgatttgcatattgacaaacgtatgttcttgctgtatattggtaacagaacagttgttcgggaacatgctttctggtatataggagaactgaaaagattacagaagaaaagggaggaatttatcatgcgatcagagaaaagaaaagatatgtatgcggatcgatatcatgcaggagcaaaaggacagaagcactgtcattatgcaaagcaccgtaagacgaattctatcagacggtttgtgacagggattgcggctctggtgatggttatgtcactgagttttggatttggaagctttttctccagtgcgcacgatagcaaagctgaagaaccttccggagagagatattataaaagtgtccagcttgaaaaaggggattcactctggagcattgcacaaagatacagacgaacagaagattccatatatgaatatatggatgagctggcagaagcaaatcatttaagtttaaaagacaggaataatctccaggaaggagactatctggttgtttcgtattatggagatgattctgtttattaaagaccatctgtgctgtcaggtagcagcgaataatctgcctgatagcacattatatacactctattttttataaaagtctaaaagactaagacattcttaaggtctctaaccaagatcccatcgctcaccccgtcttagtctttccggactttttaattttatactaagaaattatttttaatataaaacagcagacagagatttatttcacaatcagaaagtagtataatcaaaaagagagtgcaataatggatgcgaagaagattaattataagacaaaacttattttatatttttaaggctatacttgattttactagtgactttaaaggattatcatgataaaatcaaatgagtgtatttaattttagaataaaagaggagattttgttatggataatcataaaaaaaggagtacattttctggtaaattaggatatgtactgtcagcagcaggagcttctgtaggtcttggaaatatctggaggtttccttatcttgcggcaaaatatggcggaggaatttttctgcttatctatattctgttagcccttactttcggttatacgatgataattgctgaatcagcaattggccgtatgacaagaaaaagtccggtaggtgcgttcaaatctttcggaaagtcaaaatggatttcttttgggggatggattaatgcgattattccggttctgattgtaccatattattctgtaattggaggatgggttatcaagtaccttttggaatatgtaaaaggaaacagcagtagtctggctcaagatggatatttttcagagtttatttcaaatggattttctacagaaatctgttttattatattctgtctgattacattgattattatttatgcaggtgttcggaatggaattgagcgtgtttcaaagtttatgatgccgattttgatcgtgctttcgctgatcatttccatttactcagtaacacgaccaggtgcaatggaaggcgtgaagtattttctggtgccaaatccaaagaatttctcatggatgtctgtggtagctgctatgggacagatgttttattccctatcgatcgctatgggaattttggtcacatttggttcttatatgaagaaagatatttcgattgaagattctacaagaaatgtagaagtatttgatacagcgattgcaattatggcaggacttatgatcatcccagccgtatttgcgttttcaggtggaaatccggatacgttacaggcagggccggcactgatgtttattacaataccaaaggtgtttgagaatatgggattgggaacagcaattggaattctgttctttctgcttgttctttttgctgcgctgacaagctcaatcgcattgacagagagtgcagtatctacatttgaagatgaaatcggctggagtcgtaaaaagtctactgtgcttgttggtgtgatcatgatagtattaggaagtttatcttcacttggatatggaccacttgcatttgtgaaaattattggtatgcagttcctggatttctttgatttcctgactaattcggtaatgatgccgatcgcggcactgatgacaagccttttggtagctagagttgttggggtaaagaagatagaagaagagattattcatggagaaagtgcattccgcagaaagaagatttttgctgttatgattaaatatctgtgtccaatctttgttctgattattttgatcagttctgtggcgaatgcatttggatggatttctatgtagaataatatgtgaaaaaaggagtgtaaagaaatggaacagatgaaagttggaattatcggtgctgggcgaattgcagcaaatatggcgaaaacactggacggtatggacgatgcgactgcatatgccattgctgcaagaaatcttgacagagcgcagaaatttgccaaagaatggggatttgaaaaggcatatggctcatacgaagaactggtaaatgatccggaagtagagttgatttatatcgcgacaccacatccgtttcatatagaacaagccaaactttgtatcaatcatgggaaaccggtactttgtgaaaaaccatttactgtaaatgctgttggagcaaaagaagtatttgctctcgcaaaggaaaaagaagtctttattacggaggcaatttggacaagataccttccatcccgtaaaataatcgatgatattattgcaagtggtgaaatcggagaaataaaggggatttcagcaaatctcggatatgatatgcatacaaaagaacgtctgatcgatccgaagcttgccggtggagcgctattagatgtaggtatttacccactgaattttgcgagcatggttttaggcgatgatgttgaagaaacgctttcttcctgcgtaaaatttgacagtggagtggatgcacagaattccattattctgaaatacaaaaatggatcgatggcttctatacaaagcagtgcacttaccggtacagaacaatatggtatgatatatgggaccaaggggtatctgattgcggaaaatattaatgatattacagcggtaaaagtatatacaccggatcgggaatttgtaagggaaattacaatgccagaacagatcactgggtttgaatatgaagtacgcgcttctatgaaggctatccgtgaaggaaaacttgaatgtatggaaatgccgcatgaagaaagtattcgcatcatggaacagatggatggccttagaaaagactgggggattgaatatccatttgaaaaaggaaacagaccgtgctagtaattataattagctgtccctggcaaaaagttgtcttgggacagcagtattttgaataaccaatctatacgacaaataccgatttttccaaaagatatagacaaatcttccgaaaccatgctataatcatacctatatcggggaaatttatggaatttaggaggttcttagaatcatgccatctgatacaaaaacataccaggaagaaacttatattgataatactattcgtcttcgtggtgttttaaacaccatgcctgactttgcacgtgattattttcgtgccattgaaccaaccacatcaccaaagacacgaatatcgtatgcatatgacatccgtttgttctttcagtttttaattgaagaaaatcctgtttataaacatcactcaattaaggactttcaggtacaggatctggaagctattcagccggttgatattgaggaatatctggaatatctgaaggtctatgatactacagatgttcataccaaagaaaccaaacaggtcacaaactctgaatgcggcttatttcgcaaaatgtctgcattacgcagcttttataattatttctttaaaagacagataattcagaaaaatccgaccttatttgtagatatgccgaagttacatgacaaggcgatcatacgtttggataccgatgaggttgcaaagcttttggattatgtggaatcctgtggttccaaattaaccggtcaggcactctcctattataataagacgaaagaacgtgatattgcgatcattactcttctacttggaacaggtattcgagtatcggagttagttggactggacctgtcagatgtggatttcaacaataatggggtcatggtgacacgaaaaggtggaagccagatggttgtttattttggtgaagaggtggaaaaagcacttcgcaattatctggagacataccgtaaagcggtaacgccccttgctggctatgaaaatgctctgtttttatcaacccaaagacgccggatcggtgtgcaggcggttgaaaatatggttaaaaagtatgccagtcagattacaaataaaagaatcacgccacataagctcagaagtacctatggtactgccctttataaggaaacgggggatatttacctggtagcggatgttctggggcacaaagatgtcaatacaacgaaaaagcactacgctgcaatcgatgaagacagacgacgtagtgctgcaaatgtggtaaaattgcgggaaccgtaaattgtcaaaatacggttaaataatatcctaatatggataaatttttacaaatgataaattggtgaataataaaatgccatcatcatttcatcgatgtgactgatatgatggtattttattatttttttactcttaatgtccttaaataactcttctgttccggcgtgatccggtagctttcaattgctttctgaatcgtcttattatgtgtccaggtgtccagccttttctcttccagataaggaatgatctggtcataccgctttgcaagagcggtagcaaaataccaggcacgcatcatgtttacataatattcgtctgatttaacttcggctacctttttgggatattccggtttaaactgttcatccagataataccgcatcagcattccaattccaaaacggacgatataagggtgatccgatgctatccagcggtagacttcctggataaatatgtccagatgattttttactgtccggagcgcgatcatatcacaggttgcccagttatctatatacgggagaaaacggtccagtgcggcaatacaggatgggtacgctttaatctgttcaatcagcagtccatgaaggttgttttcttcataatatttatgtggaagcacttcaagaaatgcagaaacattgtctgttttaccgaatttttttgcgtatgtgcgcaaagaaggagtccgcacaccgatgacggtttccttattgactgtcggcatcagttttgcctgaaaatcccgataagcaagatcctgtattgcaaagagatctgcttgtacattttctattacttctctactgttcatttgtcattttctcctgaaatattgtagatttataattcggtataacgaaatttgctacagcttgacagtggtttaagcatttataagatcgtgcctgtctcatagagcgcattcttccgctccatacgctttaattccggcaatacggtaagtaacatggtgatgaagcataatcctccaccaatgacgttagaaaccggctcagcgagaaatacgccgtttgttcccatatgcagggcatacggcatcagatatgtcagaggcacgacgataaataccttccgaagtagtgagaaaaagattgcatgctttttcttattcagggatttaaagaccgtctggccaatgtattgcatatccatgcagataaacgctgcaaaatactgcttcagggcaggaactgcatctttcatcaacgtagcatccgaactgaaaattccgatcagggttttcggcgcgatgatgataatactccacatcacagctgtgtatccgagaatcataagtgccatcatggcaccggcttttcttacacggcatgggcgtcttgcaccataattgtaactcaggattggcgaagtcccttcgttgattgcataaatcggagtttctacaagctgtctgacactggatacgatggtcataacagaaatgtagatatctccgcctgtgacggaaagtacattgttgcagacaatcgttaccagactgtttgttaactgcatgataaatccggcagttcccaggcttacaatgttttttgcataagctgtacagctggcaagttcctcttttttgaggagcctcactttcagttctgctttctttgtaagaaagaaaaatacaaatgcagcagaaagtgtctgagaaatgaccgttgcaattgcggcaccgcgcacgccaagcccgaacacaaaaataaacaacgggtcaagcagcaggttcgttactgcccctatggtaactgaaagcatgccgatggttgaatatccctgtgcattgataaacgggttcataccggttgcaatcatagaaggcagagttccgatcaggtaaagcatcaggtacggatatgcatagattagagcgtcttttgaggcaccaaacagtaccaggatcgggcgggcaaataaaaagccaattaccatgagtacaatggcacagatacagaccatggaaaaagaaatattcataatttttttcgcttcctgtggctcatttttgccgcgctcaatcgaaaataatggtgcaccgccgcttccgaatagattgctgaatgcggtaatgatgacaattaccgggaaacaaagaccgactgcaccaagtgctgcagttccgatgtgcgggatacgtgcaatataaatccggtctacaatgttataaagtaaacttaaaatctgggcaaccagcatcgggagtgatgctccaaggatattactggttatcgttccattttcaaaatcgactcgtttcatttgtaaattcattcctttttatttttcttgctttttaattctaacatgatgtaatatatatgtaaattattgtttttatatgataattcaataaaaatcatatggataatatattttcatttttaaataatcaggagatgaattacatttttatggaaatcagacagttggaatattttcgtgcgatcgtagatgccggaacgatcagcggtgcagcaagagttcttcacatgacccagccaccgctgagctatcagatgaagatgctggaggaagaattacaggtatcactctttttgcgaggtacaaagaaaattacgcttacagatgccggaaagacgctttatgagcaggccggtaatcttctgatgcttgcagatctgaccaaacaggaggttgtcaaatccggtcaggcagctaccctgcacatagggatcacaccatccactgtatcgatgatgtccgaatatctgctttactttgcaaaaaaatatcctcaaattcattttgatgtacatgaaggatctacatttacactgaaagatcagctggaaaatggaatgatcgatctgactacactccgcacaccaattgtgttaaatggctgtgaaaccaagtctctttcccgggagaagctgcttgtgatggcagttcctgatcaccctctgttgcagggacatacatccatcagtctgcgggaactttccgaacaacccttaatcctctcccatcgctaccgcaaatatatgcttgctgcatttgagggtgccggactggtctgtgatatttattttgcctgtgaggatgcccgcactgcaatgacgatggcagaaaagggattgggaattgcgattcttccggagtctatgctgaagctcactaataaattaaaagcatatgatattactggagctgatcttacaactgaaattcttcttgcatggaggaaaggcaggatgccggcggaattacaggattttctgacattatttgaggagaaaatataaagtaaaagagcagagatactttcgaatgactctgctctttactttattttatcatttggtaagtattttttaaataggataaatagaattaccagcttgatttctgctcatctataacttccaaagtctccggatttaccagatagaaatcaaccagttctgtctcatatccaccatccggatataccttttccagaaccaattcttcgaaagtattattattttcatctgacttagaaccgttatcatacagacagtaattgacatttactgttgtgccatccttctcttctgttgtctcagagaggatcgcgtaattttctccctttgcatttgccgtgtaagtgaaattcatatccggaaggggattctgttgttggatatattgatacacagcacgcatttcgtcctgaagcggtgaagccttctgggattcctgtgccggagaattttcggtagaatcagtggtactactatcttgtgtttccgaatcattcaggtcagaatccggtacagaggattctgttaaagtgtctgtattcggcaaaaacaaacccgttttttgcatataaatcaggttatcagttcggtactgtgtagcgatgccgtaatcaggctgtacggaaagataaatataatgctgatcttgaccggttacggtttccgttccttctacgccaaagctcacaattaaaaagctgtaaccaatcagagaaagtaagaaaagagtcagtgcggcataagaaacggcaattattcgtctggctgctttcctattaaggagacttttttgctttttatacagacagatcatgccccagatcagcaggcaggacaaggtgacggaaacgcagatgacggatatttcagcaaaataatagcggattgcatatcctgcgcttttattgataccataccatgcaccgtagaaaaaggtactgtatgccagaacgattgtaatcagacaagtacgcaggatatgctcttttcttgtcggagtgaatttttttaatgcagaaataagtctgtccatttcttctgcttcaatccaggtggtaagttctgcttcagatggatattcaccgtttgtgtcaggaattcctgtataacgggttaaaaattgattttttgtatcagtatctcccacttctgctgccagtaagatctgcatataatacaactgttttaactggaccggtgtgcattttccaacagaaatctgtgtaattgtctgtgtagcatgatcgtatttcccaagctggatttcaaggcttgcaatcaggagtagcatgcggttattcgtagcaagatcgcggacagattgtatatgatacatataaagcgcatactcatagtgttcgtccagtggcattctactcgatatttttctgctccatccggcttctacaaactggagcccgaaagcaagttcgataacggcaagaatttggcaaaggaaagccgtaagtccccagacattggtagtgagtttctgataggtcagaaaaaagattgcagcggcagccaggatgacgatcaaccatctcagcataaacacgtggcgggctttcttttttacggttggattccatggatatgtttttaattctgaatctagcacgggcaaatctcctttccgttgtctaattatcgatttccaaaaatataatcttagtatttaagcgcctcctttatgacgaaataaaaggggcgcttaaatcacttttcatatttactattttacttctaccagttcgatctggaagttcagttcttttccagccatctcatggttggcatcaaatgtgatgttggtttctgtcttttcggttacggttaccgggaatggctgtccgtactggttggtcagatatgcatgtgcaccgacttccagatcttctgatccgggaagctgtgcgatttccagcgtaaaaatggcgcgtggatccggcatgccgtaagcttcttccggcatcagatggatgttgatggtctgtcctactttcattgttgcaacggctttatcgtaaccatggatcatctgtccggctccgcacacaaattccaatggctctccgcggtcataggaagaatcaaactgggtaccatcatcaaaggtacctctgtaatgggtacggcaggtctttccgacattcggaccttcaaaatccggcacaggtgcgccaccacatccgctgcatccactgcagtgtccgccacaggaatgttcttcttcagcagaagcttcttctgttgctgtttcttcatgctgtccacagcaggaatgaccttcttcgtggtgatggtcacaatttgtacctgcagattccagttctcctgcaagataggcattcactgccgcatctacttctcctgctgcaccggatataactttgataccggcttctttcagcgcttcttgtgcaccttctccgataccgccacagatcagaacatttgcactctgctcagaaaggaatcctgcaagcgcactgtgtccggcgccaccagcatgaacaatctgcatggaagtgatctttccgtcttctacctcatacattttaaaagtttctgtctttccgaagtgctggaaaatagatccgccttcgtatgttactgctattttcatttgtaaaatcctccttgagatacctttactcaatagtataacatatggattgcgaaacgcatagaaaaagtatacaataatgaaagaaataatgagacaaaacgaaagaaaaaagggactggaaaatgagtagtatttatttgagcaacgcaatatttatgatgataatactgacgatcatctttttaaggatccggtattatattacatggagcccgagtaaaaaatatacgatgatctttattggcatggtagagctttatgtgttaatggatgcattgtttatgaaagaactcttaggtaagtcaggaaaccttttgcagtttaagctggttgtgttttccttttatctggtttatgtaatcatgccatatgtgtggcatttgtttatgcagagttatatggggattaaccgttcaaagaagcaaagatttgcggaaatgattccgttcattctcctggttctgatggtgcttctctcagttccgacgggaattgtctggagattttcacggaaccggacctatatacgcggtacatttttcggagtgtttgccgtactcaatctgttttattacgtttatacatttgcacagacattcttcattttattcatgaacaatacaaagggtgtcagatatctcataaaatcggcactgttttcagcagtcccactgatcggaattctggcaaatacctatatcattccactttatggggcgtatccgttccaaccgtactgcctggtaattggagcactgctctcctacctgttcatggtggagcaccagcaaaatcagatggagtttgaacaccggaaaagactgtccaatgcattggaactggaaaaagaatcgacacggaaagcgaaagtagccggtgaggtaaagaatgctttccttgcaaatatgtcccatgatatccgtaccccgatgaatgcgatcattggattttctgatatcattgcagaacatccggatgatgaagaaattgtaaaaaatgcaattttcaaaattcaggcatctggtgagattcttctgaagatcatcaatgatgtgttggatctgtctaaaatcgaaagtggaaaggcagaaattgtggagatggtaactgatctgaagcaaatggaagaaaatctgaaaatgatgctcgaatacagcatccaaaagggaatgattgatttcaaagttgaggatcaaatagaaaatccactggtatggtgtgatgtgacaaaactgcagcaggttctggtaaatgtactgaataatgcagttaaatttaccccagcgggaggaacgatcacatttagctgcgtccagagaatgatcgcacctggatttgccgaatacaaattcacgataaaggataccggaatcggtatgactgaagaatttcagaaacatgcgtttgaggcatttgaaagagagcgaacttctaccgagagcaagactgaaggaacagggcttggacttgcgattgtgaagaaactggtagatctgatgcatggtgatgtgataatccaaagtaattccggtcagggaaccaaaatacagatttcacttccccttcggattgcaacggaaaatcagcttcatcaatcagataaagcaaaggaatacaaaataggtcttgacggaatgcatgtacttttggtggaagataatgaattaaatgcagaaattgccatggaagttttgaaaaataaagggattcttgtgaactgggttccggatggatgcgcctgtgtggaagaaattcaagataaggaagcaggcatatatcagtttatcctgatggatgtacagatgccacggatgaatggatacgaagcgacacagaaaatccgtcagcttgcagatgtgaagaaggcacagattccaatcattgccatgactgcaaatgcatttgaggaagaccggaaacatgcgctggatgctgggatggatgggtttattatgaaaccgttccgggtggatgaaatgatgaaggtgatcggagaagtgatggaataaatgaatgtggaaagagcagggaaagaactttggaaagttcatcccctgctctttgtgtgtttcatcaatctacgcggctatgttgcccgcgttttttgtaatctttatcaatccgctttttccaactagaatcaagcgctgcattgcaccgaacagcagatatggcatcatttaatacttcataattcaatgcagttccttcgcagtcacattgataattggcagctttatctgcgtcaattccaaaatgactggctgtttcaatcgcatcaatatttgcgccaagaaagagaaattcccatccatatttttctttttgtcgttcgatcatctgctttactttatcaatgcgataaatgtggcttgcattttccattccatcagtcatgatgataaaaacggtatgctccggtacatcttccgtgcgtgcatatttgtggacatttccaatgtgatggatagcaccgccgatcgcatccaggagagccgtacagccgtacacagaataatcgtcttctgtcatagagggaatcttctgcacctctactctgtcataaaggactttactgttattgttaaaaagcacggtagaaatcagcgcctgccctgcctctcttttctgcttttcaatcatagaattgaagccgcctatggtgtctttttccagtccgctcatggatccgctgcgatctaaaataaatacaacttctgtcagattttttctcatactaaatttcctcctaagtaatggcttattttgtttgtaactataggatactgccattttcaggggaaatggtcgcatgaaaagcgacacttttttatggatcagaaaatttctacagaatcatatcaggtgaacaacgctatgtgccaaattgccaaactattttcttcttagcctccaatcagactttgatcaaaggcaaagagtgcttcattgatttcgtaaatactataattttgcttcaagataaaatattcaacgattacgtcaaatttgctggaatgagacagggcaaatcctgctttcatcagcatatcctgaatttccggaagcggaagctcaagtgccagcgcaaatgcaagaacggtcggtttggatggtttgtagtacttgtcatttttaatcttggaaaataatttccggtcaatattggctttcttataacactgagaatcggtcattccactttcatcaatcttccgaagtagcatttcagaaaagctttcatccatttgctgcaaggcatcttccaaagttgcagctttacttaacggtacatttgatggctctggtaaagatatgctttcacagagatccatttcccggaactgcttctggcgcctcattgcttcggatgttttgttaatgtgtgtttctacataatgatcatcgatataagatgcaatatcagaaaacagtttgctgctgatccgataagctgctttatcaaaaatgacgatgtataccgtcatatcattttccataagaaatgcgctgatcgcgtcgattgcaaccttcagcgcctgagctttcggatagccgtaaattccggaagaaatcagtggaaatgctatggtttcacaatgtttttcttttgcaagtgctaaggaattttcatagcaggaagtaagcagctcccgctcatgaaactgtccgcctctccatataggacctactgcgtgaatgacataattgcaaggcagatcataggcgtttgtaatctttgcatctccggtctgacagccgcccaaagtgcggcattccgctaaaagctttggccctgctgcacggtgaatgcagccatccactccaccgccgccgagcaaggaggaatttgcggcattgacgatggcgtctacgggcattttggtgatatcatttctgacgatttgcaatggcataattaagcatgctcctctaaatatttttcaatctttccaattagcgcctgatctgccggaagccagtctacgctgtaaagagtctctttggtgagccatttggcagcttcatgctcttttagaatcagatcgccggattttacattacagataaaacaatccattgataggtggaattttggatagtcatattctacggtgtcaagtaactgaatgacttcgatttttgtatctaattcctctttaatttctcttatgatggcatgttctggcgtttcatctggttcgatctttccaccggggaattcccagccgtctttaaattctccataacctcgctgggttgcaaatattttattgtcagcaagaatgattgctgcaacgactctgattgttttcatggtagttatctcctgttttgggtaaaaattcatataattttaaatggttcaattattgacaatttttcttttcatgttataatgaccgtaggtttatagtgcttttgtgttggtgtctgtttacagtcgtcgcatagcctgtatccgcgctgcccgagtctccgtgatggtgtctgcttgcagatgcttgaatcacggggtctttttttgtctataaagaagaaaatcatatattctaatcattcgtttaagactacttctatcagaggtattagatgaactaagaatattggcattttctttaaatattgtttctaatatttgttgatattgttctacatcgattttgtcttccggcagaaatcccagtagccttatcgctttgaagacgtttgttttttcttgtgtccatatttccattgcagtgcgacctgcgatagcagtccgatttcgcttgatggaatcttctgaaacgatatcattgtatgaatgcggcgctttgctttcggccaagctacttttatagtctgaatttgcaatataataccatactggaagtttccatgagttttgttttgctaattctggataaacatattctaacaatttatcgcatgaatacatagaatcatgtaaaataatattgcgataccactgttctgaatttactgctcttgctaatccatatacacctgttgaagctaatccgatacttaatgctagcatattttcatcaatacgaccatcatcgagtgctgcaacttgcatagttggtccaggctgttgagttaatgcaaaagaatataattcatctttaaagcgtctaagtaacttaactggaagtgcagctttttttgcggataaagcatcatataaaattccaaagtcagaaagaatgattttagtcatttcaattaattttccgtttattactaatgaatgagaagaaacttcacagtcattagtatctttttgatagtcaatgaatataaatcttttctgtagggaatttactttttctggtggtaaacactctactacatctccgagaatttcttgtatatcggaatctgaaattgaatatccgatgaatacaattgggtattccataaaaatagtcataagttttgctgcaaggtatttccctttttcccgaaatgtatgataatcatttttattaataacaatagacaaaggggatcgtacagaaccgtgaattttatatatttctgctactccctgcaattgagaaaaaacgagttcatcttgtccaataaatgttttataaccatcaaataaaatttcaaaaaagcaatcataattagttgtaattacgccagaaatattatttttagcaatattttgaagcttttttacttcttcctgatattcattttttactaccgatatagaatttatatattcagcaatttcagctttaaatggagaaactccttcagcaatagatctttgaacattttctgattcagatctaattcctggtaaattattaaaccacgcttcattaaaatctttttcgatataactagcaatagtaggtaatttatctgaatcttctagttctgatactttactttcataataacgaaatgcgaattgatcattttttactttttcagcaaaatgggtaagtaaaccaacccaatctggcaaaccataataccttcttgtaatacctgatccggcaaatagaaatggggttgtattaaatcttgcaacaacttcttgtaatgtcataaatagtccctcctcgtttatccatttacgatatattcataaatatcttctctcaccggtgtatccagaacccattcgatctccactgctgtcttatccgtattcggcataacgaattcctttacctgcccggtcgcattcacgcgtccaagataataaaattctttggaaatcttatcatctttattttttcgcacaaaaagctgaacatcaatcccccgttcttttgcatgcaaaaaattctgtacatcttctgaagcaatggttcttccgcttttggaaatagcgatcaaacggttatcccctacaaaatgatcttcatatttagtagtatcactgatatcatcctgtttatcataattgataaaaatcggaaaagtctttgttttcttatcgaacttataaccacctatgttgagagggacttcatttctttcccagttcagcagtcggcagacatcttcatatgtgtatttctgatataataccaggtctgtattctgatagcgattgcagtagtttgcatggtaccgcgaaataccaaagtctactaattcctctaaaatatgatagaaatctgggttttgcagcattgcttcgaaagtctttgaaacggcatagtcatcctcttctttttcgaggaaaacacagtttgcataagtcttttgcgcagcgtttgtcgggaaatgattagtcatcatgtttatgatattctcagcacaattctcatccatggactgctgataattttcggaaagtgactcctgcaaaaggccaagcagaccgtgatgatatttcaatgaacgtttcagcaattccagttcgtggattcgcttaccacttgccagtttctttgaaacaaactcgattactttttcttcgttagcagataaacggattttgtattctttctcatattttacgagaaatttataatacgatcctagactgttattgtcaaaaatcctcaaaacatccatttcaccatatttgtcaaaatcagcaagtgccgggatatgtccaagtttatttttcagattcgtatagttttcgcggatcagcttaatatcgctgaaatttgcattatcaatcgcctggaaaattcgttttctggaaatctcgtcaaaatggatcgtgcttgcaccgggaattactctgccgccttctgttatgtaacggcggatattatccttattgtaactgcgatcgccggacagggcaattggaatcataaaattatttcggtaatttccaataaaatccagtacgaccacgtattcttttccttccgcttttcgaagaccacgtcctaactgctggataaatacaattggtgattctgttggacgcaacatgataacctgattgatctccggtgcgtctacaccttcagaaaatatatcaacagaaatgatatagtctaatgcatctttgctgtcatctcccgtaaggcgttcaattgcgtcttcacgcattgattctgagtcgcttccgctgagaacaatcgtccgccaccccttttcgttgaatttgacggataattcttttgcttcatcaatgcgactacagaaaataagtcctttgacacgttctccactgtatccgaaaaactcggcctgtttcataacatttaagactctggtatccgaagttaaataacggaagttttccatcttttcttctgatgattttccacagtcactgataatttccagatccgtaattccaaaatagtgaaaaggacaaagtaaatcctcttccatcgcattttgcaaacggatttcataagcaatctgatgattgaaaatctcataaatatttcttccttccagattgtcatctcgtttgtccggtgtggcagtcattccaagccagagacgagggataaaatagtccatgatgcgtttgtaactggcagcagaactgtggtgagcttcgtcaataataatcaagtcccagtgatcccgctcatagtgtttcaaagtttcttctttgctgattgtctggatggttccgaaaacaaaatctgcatcataatcctgctgtttcccagtaaccattcccatagatactgttccattaaataccttacgataggatttcattgcctgctttgcaatttgattccgatgtaccaaaaagagaacacgtttaaagcctaattcacgcgttgcaaatgcagaggcgtatgtttttccagtaccagtcgccgaaatcagtaaggctctgtcctctcctgcctcataaatttttcgtagattattgataaatccaacctgcattgaatttggctgaagccgataaatctccaatgaaggaacttctgactgccgtgcaatttctttttgcttctgaatgattttattttttgtataaagcgtactatatgcatcgataaactcttcataaggtaaagcctgatcagtgttccaaagttgattaaattcatccaatatagtatgtgtatattcaccatcttctgttgctacgatcttcgtattccattcccggttcgttgtaagtgcagtaagcgtcatattggaacttccaacaataatctgatagatattctcttttttgaaaatgtatcccttggtatggaacccatctttggaaccttctgacatgaacattttaagttcgatatttttaaaatttgccaacatcctgagtgctttcggttcactaaatgtcagataatcggttgtaagaattttacctgggattccacgctgctccagttctcgtaaagtttggagaaggggtgtgattccgccctgagtgataaaagctacactgatgtaaaattcattgcatgacaaaagctcatcttcgatggatgagattacttttcgtccttctttataattgttggatacaaactgtggcttataggccaggttggaagtaattgcctggtcaatgaaagcagtttgtagaccttgggttagttgttggattttatcgttagtcatttgagtgttactcctagatggaaattgttaaatttatccacaatgttattttttattgttcctaatgaaatgccagtttttttctgaagttcgctttgtttgataaatggatttttttatcaactgaataatctctgactcatcttttgttccaaaattgcatctttaatctccaaagttgtacttactgctttggtatttgaacaataatcgtaagaataattttcattcaatggtacattgattcgaaataccttctgatttagaacttttaatagattacaaaaatattccctaatagtgtttaacttaattttccgccaaatgcatttacaacatcttcactatctcttccagaaatcgattttcctgtagctttttcaattgcatttaataacatctttgcacgtttaataatatgttcttgaaaattatcatttctacaagaaaccacatcaatccaatgagttgtcaaataagtgtctaatatatcagaagaaacttgtcctttattttcaatttttgtaagatatacgcttggtgcaacacctccaatttctcgattggtagagtaagtaataggcgttttgttgattaccgaattccattttgctttatcatatttctgtttttcacagtaatcttttggaaatatatgatgaatatcaatattttctgccttataaacagaaaaatccatttctcttccagaaataaaatcctggcaatgattttttaatatcaatgccataatccctttataagcagcggataatctggactgtaatgatagcaatcttgtaggattaaaataggaatcctgaacagtttttggtactttggtatcgtctgaaatccaatccataacacctacaacgtctaaaacatatcgtgtttcatttgcactgccatacatttcaccaaatactccgcaccagtaccattgttttattttattcttgatagttgttgttttaatctggttatttttagaaaggattgtacataatacagcaagtggaataaactgtgttgaatatggcaaatctttactggaaaagattcgttcttcctgaagaattttttcagcttctacaaatccgtttgttaaatcatctgcatacttttgatattcgtctaatgtaagatttaaaacatcttttttcttacagcttacagtgccacctttttgataagtagaaagtagagtacatgtagttaaaaaatccgtagcagaaataattgataataaatctccattaaagtatgcattttttcgctgctcccagtcttttctaagctcaaaatcatccattgcgaatactgcagtaatgagttcaaatactgtaagagaaacaccaccggtatttacattttcaaacacctggcaaacagcttctttgggagtatttttatccaataaaatgacaggaattttatattgaaatacaggcataataatattgccttgaaagttcatccattcttgtacaattgttgcatcattattatgataagccatgtagttttgcatccagataaaggtttttgagttatcaaggataatatttaaaggaaatagtttgtgttcatattctttatcaggagtagataaatctaattcaatatctcttccaaaattggatgtaataagtctggtctctggtattgaaatgatagcgtctactctatcggtagcagagtctaatgctttttcaatatcgatatagtaaaacctctttatatctttacctttatccgttctggtatgaacgggattaggattatataatgacgaataaatagatgtaagacgctgctgaccatcaagaattaattcggatggggcaatatctttagccggcgaaccttctattactcgatatttaaaacgaatattcgtattcccatattccagaaacattgcggctccgactggaaaattgtttgtgatactggctattagtgcacggattctgttgtcatcccatacccaaccacgctgaaaatctggtaattgagtagtaccgttgtcgattgatttcattaaatctgtaatttgtcgatcgtttgtttgcataactgttccctcatgctttctataataaatatatttaggattacatacaatattttttatatgcatccataatttcattttggattttgtcttggaaactttttggtccaataatttcacattgattgatgtgagtcattacccatgaatatatgacggatggtattgtattaatttttactgtaatattttctttatctttttcaatacagtttgttttgttttctgaacgtaaaaatcgaaaaaataatttttttaacttacgtctataagaatcttgtaaataaaagcgattaaaaaaagtataacgatttccacgattaaaaaaatttttatcttctataaacaaaacacattctggagcacaaatttcgtcctctctttctgaaaagggtctatatttttcaatattatctattttttctttaatttcgtcaaatgaagcaattttgaatttttcacttgctgagtttttacatcctaaataaataaaaatacagctgattatcattaatattatttttactgtgtttacaaaacaatttaaaatccaatcgctacttaaaaatagagcggcagaaaaaaagattaaaggataatgtgttatcataatatacaaaaaatcaagcagtttttctggaaagctattaattattatttttttgaatttatcatgaagaaattctatatctaaaaaaagtgctaacaataatatctcatatgattgaaatgtaggaactatatttaatacattagctatgtaagttattaaatacattaatatgatttttttataatattcatctatatcaataataaaagatatatatacccagaacaatagaataactgagttaccaacaaataattcttccatttattacattatgctgtagataacagcaacccccttcttttcattagtttaacatattgactttaatgtaatgtagtaattattgagttgtttctatatgcaaaaacgaattttcaattagcttttactcaaacattatcattggattcaaaccaactaaaatgtcatctttattatatcccgcccatttccgcataataatttttcaaatcttctgtcaattgttctttcactcttgtccaatcttcctctgtcatctgactatacagtgcatgattcatagaaatgacacttagatcttttgagtaatacaaaaatctcttccgctcaaacttttcaaatggattcgtaagcatatttctgctaatagcttttcgatctttcagcgttttttgattatacgggcaggtgcttctatctaccggaagtccccggtcaatccgattctgataaaatccaatataaccgtccagaactttttctatgtccgcatctccaattgtattaacagcttttataaaagataacataaatggcattttgtacgaaagagaataatcccgttcctccaaaaaatcaaagaaatcctgttttatcgtattgtcattatgttctttaatatttagctcttttcgatatttctctacatcatccggactaaacaagtaaatggatctgcttccgaatttatattctgcactcggtatgatttttccttttttaatccagctgattactgttcctgtactgacaaaatattctctggcaatctgttcctgactcaaataattgccatacttatcttcaaatgaatcaatgtcaacttctgatatacgctcaatccgctcttccattccatcaatgattaccatttctcccggcttataatccattttagtaatgtcaccaaacgggacgtaatatggattagcaaatattgaatgcatattgcatgcttttaccatagcaccatattcatctacaacatcaatcacgataacgttcttttttctatctgtttttcttaagcctctgccaatctgttgtaaatacaacacctttgacaatgtcggtcttgccataacaagaattccaagttctggataatcccatccttctgaaatcatattacatgcacataaaaaacgaatttctttctgtttaaatgcattcattacagtatcttgattttttgtctgacgggtataacttgatgctaaaatccctgcctgatttaataattttgccatttcattcgcatgagctacattaacacagaaaataactccctgcctttttcctgcttctccttctagaaaatattcctttaaaacattcacaatcagttcatttctagaagtaactctaattcgcttttccagatctgcattcacataatctttcccattaaaacgtacctttgaaaggtcaatattcgtctcaatccggtaaacatttgcctttgctacgatttcctttttcattgcttcttttaaagacaatgatgtggaataagtcccaaaaacagtttccagcttctttttatccggtctttgatccgtagcggtaagccctaccgtaaaatctgtatcataatattgaataacccgttttagaatcggtgcaaccgcatgatgtgcctcatccactacaagataattataataatctgacggcatttccgtatagtgtcttgccatatatgcataagttcgtatctcaatatgatccaccagttccggcagagacttttttactctttctctccaatccagcagaatattgattcccgggactaagattaatgcatgaaagtccggtttgtcattcgcaaaaatgcgcaaatcttcttccacgatttttgatttgccagacgctgtaggcaacacgatcaaaaatgctttcaccccagcactcctacgtttttggatttcttgcagactaatagtctgatgttcatataattcaacagctctgtctattttgagcccatcatcaacaaaattggatgcatcttttcccagaaactgtttgatatcatcctctattcggttctcaaatgcacaatcttcactggaaaatcgaaataattttattccccataacatacaggtattttgtttatgcaattgattcctatatttttcttcaccgataatctgcggatggtggtatgtaacaccattttcttctattgcatattgcccatttttggttcttattagataatccaggaaataatttttcccagcctcatcacaaatgccgtattctctcgacaaatatttaagtgcattcattccatatacattagaaaaattttgctcgaatcgaaattccagtggagatacatctgcctgctctccacggtctccaatactaactgtataatctacagttgctgatatttctttgtttagcagataacgatccacttcttcttgtgaatatcctaaaaaacgaaagactctattaaactggtgcatataattattctgcttatcagtaataagcatatatgaaaagacagcctcgcctttgttacaatcacaaatgtcttcgtctataataaccatatccgtgccgttatcataaaatttcgatgttccgccattcggataattcgcctgttctctcaatccaaaatcaacatgatctattataaacttgtctttcgtaatagtaggttcagccacttttgatcctcccgtcctggccgtacatcaccggtataccaatattcttcaatcgctataccttttatatctcttataaattcgcagaaactttcataagtgaaatctgtgaaatatcttccatttctttccccctcaaactctccgtatttaaaagaagtataaatgataccattatcagtcagtgcattcagcatcttcataagcacacttcttagttcttcttttggcaaatgcagaatggacgaacatgcccatattccatcatatcggcttcgatcaaccaattcttgaaaaagcatctgctgtactgggattcctacgtagctttcagcaatttggcatagttctgctgatccatcaatagctacaacatcaagccctgcttcaacaaaatattttgaatctctgcctgcaccacagccaaaatcaagcacacgcttaccttgtaatatattgatgaatttatcctgcgtttccttaaaatcgacaaaagctgtttcttccgcaaaagcttttgcatttttattataaaaagctaaagttttattattcatattattttcccatcaaatcactatttagcaaaccatataatcaaattcttcgatattttcaattcccatctctcttaatacttgaacagagtatacaatatctttatcacaatgatattttggtatatgaggaactctcactcttatcttgcattggggaattcgtgtacataacatttttagattatgaattacattttcattggaacatccggtatataattcatatatccgtggattcatatctttaacgtctatatgccatacgtcaacaacatcaataagtttttccacatcatatgccaatacatttagagaagtctggacatctatgttccattctggatattgttgatgaaatgcctgaataaagtcagcatacaatagcggttctcctccgccaaatgtgacccctccatttgacatttcgaaataaactgcatctttttcaatcatacttcccagctgctccacactgactttcttgtaaaatggaaatacattaatatgttgtttattaatacaatatcgacaattcaacatgcaatgatttagcgcaatcaatgtgcgtaccccttcgccatctgtctgaattcttaatcgttcgattccgcgaactggtgcatatatttttttaccatatgctgcgtttggctttttcgttttatgccataaattcatcgctatgttttcacaaactgaacaagtgcctctgcattctgcttcaaatctacaaggcttttctaacagatgctcatgatattgctttgcatattttttccttaattcttttaagaatgaacacacttttttcccatcattcccatatacatattcgtatatactaaaacactctgaattgtgtcgaatgatttcattctcctctaactttatgagttcatatacttctttttggtgattatacagattcactttatgtgattgttgtattttatgtagtttttgtgcttttaataagattttcgctatatcttcgctaaccaattcttcataagctgtgatctgtgcaatgacgtcctccaatttttcgttataatcaatcatgccatatctatttaaaaagcaaatcgaatcgtattgatctgcatttttaatgatacgtaacaatcctttatgatcaacttctgttccttcccattcaccaagataaataagatgtaaataccattgatatttttcagctaactcaataaaaacatctaataggcaatcgattccacccgcgcagacaacaagaccaacttgcttgtcttcatttacatatttcaaaaattcccgttccatgtttctaacggagaatttagatggtgaagccaataaaccttcatgtaactcataatcgtcttctttatgataatatatcacattttttgaatttcttttttcatcacttaaatgataatcaaaatcgattttaacacatcgtaaagatgtattatttagatatgtattcaagctgttccatccaaaagaacttttttcgtaaaacattatcatttttacattacctctgtataatcctgaatcttttatttgattccaagcaattttaataagccatcagccgatatacattttcttcggctctgacatgtattatatctttttagcagaaacaaaaatgtttttatagttctgctatctgctttatattggatatttgagcaccattagaccttaatcaaacattagcattggattcaaatcaactggactattccattcaattccaaatctgtttttcagaatctttttctttgtacaccaatattcgtgacaaaatccaaaatatccgccgtcaccaatttcatctcgtatcagtcgttccaattctaattctattttaagatattcgtctgaatattctattggatcttctttaatctcaaaaggcatgttatcgttaggttgagaccaaaaagaatatccatagcgaagcttatattcgatatccttaagctctttccaaaatcctaattctttttcttcttttgatcccggttcgtctatataatatgaacaagcatctggaagttgatgatttataatatctgcaaattcatcatccaacacattgagctttgaagaactaataaaatgttccattatagcatatagatcttctttagtaatatttccatctttgtattcatcgataagagcaagtaaaaaagatttccccatattctcatcaacaaccttattactttttgaaattacatgctttatttttgaaagattaagatttatattttgagggatgagttcataaatacattttatcaaagctatctttattgatttttttgcaaatacttttacaatgtctccaggttttaaattttgtttgcatttatacagataattttttgtatgattgtctttactttcaccaaatattacgcaacaatacattcattagttctcctgttccaaaagaataacgacaagaatttactctcactcatgttcctcttcccaataatcataagcctcgtcatatccatcatcaaattcgtcttcccattcaccggcaaaatcatccggatcatcataatcatctacatcatatggatcactgttccattttgaagaagaatttcctttactgccggaattactatttccacccgaactccatccgcttccagtgttaggaagatatcctccgctagaggtatgtgcattgctattttgatcctctgatttcctgtataccagctcttcattaacaaaaactcgtacatcatcatcgtcccgatttaatgtatattgatgaagattatctttttttattgtgatattgttaagtctgttttcatcgccaataaagacaaggactgtttttccgttctctgtaaccttatgctgataataagctccaccctcatcacgattatctttcatgcagcattcatcattcagtaatttgataaacgattggaaatcgccattttttgtttcacgttcgtaaatactgtcaattgaatcactatagtagtccaatacataatatacacaatattcatcttgaccataatcccagatgttccaatactcatcaaaataatctcgggtacaggtgtcataagtcactttaagatctaacagaccaacatcttgcatgtcctcctgaagattttcagcgtaagaaaccatatattcagaagctagtttttcagcttctttctgctcctcttcgagtttcttctgtgcctgttcttgctctttttccaattgcaccattttcatgcttccccaaatgacaacaagtattaaaatggcgaaagtaatgatgcccatagcccattttgttgatttcttcataaacaaatttcccttcctcatatctttcagcttatgcccctaataacaaaaataaatttgccattcattgccaaatcaatttcttatttctaaccaaaattatatcataaaaccattaaagtttttagctgaaatcaatatttttttctttgtgtacatcgagctttgtatttaggttgctacaatttaaatactcttaataaaagtaatttttcttctttgccaaattctgttgatacaaacaatataatttcttatcttttccatctcccgtctgcttctgctgtgccgtttttctatctgtctttcctgcctccttaaccactgcattcgcttcggtacttattactcgctcatctgctcttccttcatttctttccgctacctgctgttctcgtctctccttcacacctttttcttccagactgcaaatacggcagtacatgattctgcatatccgtcagatcttccatatacttctgatactcttcattgtcctttccttgctggtagctgatccagctttcatccgtcaatttcatttcattctgcatctttaactgattgatggtaccgccgtttccggtaccaatatctatcttaccttgaaaataatgcagcatcttatcacccttctcagcataatatactgtaaaaaacatctgcgctgtcgttttcggttcgttggtgtttggatcacggtcagcataccaggctttgtcctgttctactgttttggaatccaaatcagataacttctggcatcttggattccccaactcacttttctcacaataattcacatacaccttcggttccatatcttttggaagttccggttcataggttttcagtctttccatcaacacgtctgcacgaacagacagatcggattcttcgtctacaatatccttcacgcaagaaacataataataatgaatattaccgctttgtaaatccagcattacttcctgtaccgtattttctccccgctccacattatctcgatactcatacggatcaaatgcttctgcaatctcatccagtgcctctgccagctgttctgtagtcatcttctctggatacattgcttcccgaacatcccgcatcggtacgtacttatagtccggcaatgcttcatgaattttctcaatcccctcccgtaccagtgcaagttctccataaaaccgaacatcatccatcagatttccaaatacagtatttccttttacgattgcaaattcggcttcatcgtagtaactgtcttccggatcacgatagataattcccattgagcatccgagatgtcccatgtgtatagatgagcgttcttaaaagcgtataaatagcaacagcaaagaatagatttttaaccggagttattctttgctgctttttaattcctgcgattattctttaaattccacagcatgctttcttttccagatcggaaaaagattcctctgacagacataattctcccgctctttgatcccgatcgtatggaaaaatgtcttccacatcccagtgtattcatcttcgtactcttctgttttccgaagtgcctcaaactctccgtccgtcagataacgaagataattttctccgtcttttagatggacacagacggtcttccggttatcgtcaacgatcatccaatattccgatggcatacggtctgcgaaatgtcttccaaccagcatgatcacatcacttttgggttccagatggctgacatacacacgcccgtcgagactttgaaaccgggcgaattcacggaaatgatggctttcatttccaacattacgatataattccataatccgcatcacatgtgggttcgtataatattcaagtacatctgctcctattgcaaatccaacccgcagaaaattatagattgcctgcagtgcatcttcttctgctgaaagggatgcgtaatatacatacagatatgctctggaagaaatatctctgcggatagaccgggtgactttttctgctttgaagctgaccccatctacatggatatattcgtccaataatgttgtctggaaaatcggttcttttttcaactgtatctgatcatgaccgattagcaaagcatctgcccatgcatcatagatgcatgtcatgatgtcttctaaccggtccttgcaagtatatatcttcataaatttcctgctttctcatattgctataagtattttctgccctaatgatgtaactatccaattccgaaatcagcaagtgtcatctgtgaaaatccttcatttgcatgagccattttccaggattccttccggtctacgctgaccagctgtcttgtgatataagtctcttcaagtggtgtgtgatacatctgctttccgccacaggtgatgaaatagtgcgctcttttcagcacaactcccattttcttcagacttgtgaaatccattcttccatatcttcgtgcatttacaatacggctggctgatttcggtccgactccgggtacgcggaggagttctgcatagcttgccgtttctacttcaacgggaaataattccagatggcgtaatgcccaatcacacttcggatccagaagttcgttaaaattcggtttctctatggttaaaagttcatctgcctgaaatccgtaaaatcggagcagccagtctgcctgataaagcctgtgttcacgcaaaagcggcggtggagttccaatctcaggcagaacaggatcttcattcagcgggatatatgccgaataaaagactcgtttcagatcaaatccctgataaagctgctgcgtggtctgtaataaggtataatcgctttcacctgtcgctccgatgatcatctgggtgctttgtcctgccggtgcaaagctgcgttttaatctggacatatcatgtggtgcaagttgatatgcctgattccaggtgaaggaagaatccaatagcgcaggatttgactgtgcagtaattggggatacatctgctgctttttgcagcgctgccctgctatccagtttcctttggaactgttgtttggaagtatcagaaaaaattccgttatgcaggaactgatttccacggcttctttccatatataatgattttccgattgccatgcgatgtgcggcaatggtattctgcacctttcccattggacttaggattgtctgcatagtcttgttcggtgccagcttacgaagtccctcagaagttggcagttccagattcacgctgacacggtctgcaagataaccggcagccgcaagtaattcatccgaagcccccggaatcgtcttcacatgaatgtatccgttaaaatgatatttggtgcggagaagaagcagggtctcgcacatcttttccatcgtataggttggatttttcaaaataccggaacttaggaaaagtccttctatataattccgtttataaaattcgactgtaagattacagatctcttccggagtaaacgtagctctttttacatcattgctcgcacggttaatgcagtatttgcaatcgtagacacaatgattggtcattaagatcttaagtaaagaaatacatcttccgtctgccgcaaagctgtgacaaattccacatgaaacggcattaccgagttctcctttctgtccccggcggcttgagccgcttgatgtacatgcgacatcatactttgcagcatcagcaagaatatgtaatttttcctgtattgtataatgctcatttgtcatttctgtattcatatttctattatacaaacatatgttcgtctatgcaagtgttttttacagttaaaacagaggcaatcaagaattgacctgaatatacagacagggtatgtacagcttcatttgccatacataccctgttttagtaaacatattttcttttatttaagaaatacttttgctccatgcttcatgcaactcatcaacggatgacatcacgtaatccggctgatgttcgtatgcttttgcttcttcttcagttgcctcaccggataataccagtaccgtctcaacaccggcatgatatccacataagatatccgtatacaggcggtctccaacgattaaagtctcttctttccggtaatgattccgctgcaatgcaagttctaccatttcaggctgcggcttaccaataaaatacggcattcgctttaccgcatgtgcaagcatttcacagatggagccacagtctggtacaaatccaaattcaatcggacatacatagtctggatttgttgcaagataatccacattttttgtactcagcagcttacatgtatcagataatttttcatatgtcagctgattatcataagaaactacaacgcaggtaattccttcatcctcgcaatcgcttgttacgtggattttattttttttgagttcccggataaaggaccgggttcccagcacatagatcagttctccggcatgatttttcttcagataatcaatggttacataggatgctgtcaggaaattggtgtaatcggtgtggattccaagaacctgaaaaaatctgatataatcatcgatgctcttggttgcattgtttgtgataaatacaaactgcccgccatttgccttgatgtcttttaggaaagctgcggatccttcaacgagctgattccctttacagatcgtaccgtctatatccagcagaaaaagttttttattttccagcatgatcttatacttccgcttcttttttgatctgcactgccatgtctggataattggtgataattgcagttactcctgcatcgatcagccatttcatatccgctttttcattgactgtccagacacggacattcagattgctgcctagatattctttcaggaaatctgccatttttacatgatatactgccggatgcagtccgtctacttttgtattcttcgcatactctgcaacattcaggatcacatcactgtacagataagcggtttctgcttccggcacaattttcttcatctgctggatgctgtaatggttaaaggaagaataaatcacccgctcttccattccggctttttttacaagatccgcaaccttctgctcgatttccggataccagtaaattcctgttttcagctcaatattgacctggataccggatgcttttaccgcatccagtacttcttccagggttgggatctttgctgcggaatactccgggaatttgtttttcagtactgtaagctcttttaacttttttaaggtataatccttgacccatccctttttttctgtaactctgtcgatggtttcatcatggatcacaaccgggattccatcctttgtaagctgtacgtcaagctcgattccgtcagcaccctgtgtgattgccagtgcaaatgcttccaacgtgttttccggtgcatatccgcttgcacctctgtgtgcaaatatttttgttttgctcaatgtttattgcctcgattctttttaattatttacagtattgtagtcagtgatcgctttgttgatcgaatctgacattttctgtactgctgtgttgacatcttcttttccattcagcatgctttcgatttcagactcaacagttgctcttgcttccgggaatacacttaaaagcgcaccgcaatattccggtgaagaatcatggagctgatcgattgctgtctggaactgaggatactgcgcgatattatctttgaatgtctgttcatcgtgtgcttttgtggtaaccgggaaatatcctgtctgtgcattccagtatgcctgtgattccggagagatcaggaattttacgaattcccatgttgcacggagtttctttggatctttattgttcagtgcccacagagaagctccaccgatggatactccgccttcatcacttgaagataccttcggaaaatatgcagttcccacttcaaattttccgtttacatcctgcaggatctgttttaatgaagctgtagaaccaagtgtgattgcggactttccggctgagaaatctgcaagtcctgcatcaccgccttttccgacgattggagcataaccgtctttgttgagtttctgccatgcggtcaggatattcttggctgcaccgtttttgtcaaagtcaactgctgttgcggccttttcacgcccatttccgttattggcatagtccagaccctgttttccgataaactgctcgaagaaccatccgtaaataccaagagacattacttctccggcaccgcctttgctcattaactgatcgccaatctcatcgattgcttccaggctgtccgggatttctgtaataccggctttgtcgaacatatctttattataatacataattggggtagatgagttaaaaggcatcgaatataattgattatcaatcgtataatatgcagcaaggttcggttcgatctcggatacatcataattatctgcatcgatcatttcctgcattgacactgtccaaccggattcgatcataaaacgggtaccgatttcataaacctgtaccagatctgcacccatatttccgatctgtgcgctctttaatttgttcagagaatcatcatattctccctgatactgtgcttctacagtaattccatattcattttcatcattaaattttttgacaagtgtatcgattgcctgtccattaactccacccatagaatgccagaaagtaatggttgttccgtctacatcctttgcatctgccatttctgctttttcattgccttctgctgcatcggatgagccatcctggctaatggaagattttccaccaccgcatcctgcaagcattccgacagccattgctgctacaagtaataatgaaactgtttttttcttcataattttcctcctgttgtgatctcttctaattggatgaaattgtgtgtaatatttacacatatataggatcgggaatgaatgttttcccgtttccagtataggaattaaccctttacagctcctgagaacattccccggatcagttgcttctgtccgataataaaaatcgaaatcgatggaatgatgatcatgacaacacctgcgatcatcagggtaatggactgcgaatccacactgtcaagcatactgataccaatctgtacggttcgcatgttgttggaaccggttacaagaagtggccacatatacatatttcatgcattgataaaagtataaactgccatagctccgattgctgacttggtcagcgggatcagaatcttaataatgaatttcaaattactgcatccgtccagttttgctgattcatacagggacatcgggaatgtcatatagaactgacggaacaaaaagattcccatcgccgatgtcagatacggaatgatcagtaccgcatacgtatcaagaatcccccagcttccgacggtcagataattggaaatgatcgttgcttcgccaggaaccatcatggttgccataacaattgcaaaaaggattccttttcccttaaattccaggaaggaaaatgcaaatgcggcaagggaacaggaaatgatctgtccgatggtaatacatcctgccatgataaatgaatttaaaatgaaccggagaagcggaacagttgtaaatgcctccttgaagttctgcagtgtcggatgcttcggaaaaagattcagatccgttgtaaataattcattggatggcatcagcgcaatgctgaccgcgtataaaagcggaagcagtacaaggattgcgaaaatgatatttgccgcaaggcgcagtgctgtcttacttcttcttttcgccagtgccttggcgttcattttattttttaattccagaagttcactttttgaatattttccttccatcggaattgccatactatttaactgactcattagtaatttactcccttcttctcaatgcggaacatcaccaatgttacaagcatgataatgacaaataagataacagactgtgcggatgcacttccaaaacgatagttaaagaatgcatctctgtaaatcgagtatacgattacgtttgtggattcattcggtccgccttctgtcaggatcttgatctgtccgaatgactggaatgcctgaatgatgtttacaacaacggtgtaaaacatgatcggtgacagtcccggaagtgtcaggctgaaaaattgctgaaccccgcttgcaccgtcgaccgatgctctttcataaatggtttcgtcaatatttccgagtcctgccgaaaaatacagaaaattgattccgctatttaaccatgcggtaaggatcgcgacacagtaaagtgcggtgtttggatcgtttagccagttgatatcaagtccgagaagcttatttacaattccgactgccggatggagcatgatctggaaaatcatggctgccgagcttgatgcgatcgccatcggaagcgcgtaagcggtactgaatacgcggattccaggaaaagctttgttacaaagaactgcagcaatcaatcccaggagcattccgccgagtacaacgatgacaacaaaggccaatgtaacttttaaactgtttctaaaggattctgaactaagcagatctatataattctgaagacctacaaagatttttgcctgtcccattttgtttgtcataaaaaggcttaagtaaactgtctttacaaatgggtagaacaaaaatactgcaaagatcagaatactcggcaccagataaaggtacggtgtaatttttagattcttttcttttttcattcttaatatcctttcctatatagattcagaatattttcctctgtctctgtatcaaatatgtgaatccgatttggatcaaaatacagatctaccgtttcacctacttttgtctggttggatggctccagccttacagcatgcgttctgtgctgttcatcaaaatacaggaatacttctgctccaagcatttctctggtaacgacggtttcccgtattccggcactgttttttgcaaatccgctggcttttgcttcttcgtattcatagatatcttccggtctgattcccagggtcacacgttttcccaggtattctttccggagaatttcttcattacgcccagttggatatactttttttactggtcctgttgttgcaaataacaggactgtcttatcaaattctttttccacttcgcattcgataaaattcatggtcggtgcacctacaaatcctgcgacaaatttatttaccggatgatcgtaaatgttctgcggggtatctacctgctggatcagaccgtctttcatgacaacgatttttgtcccaagcgtcattgcttctgtctgatcgtgtgtaacataaatgatggtggtatctaactgtttatgtaacttttgcaattcaacacgcatctgcgcccgaagctttgcatcaagattggaaagtggttcatccataagaaatgcttttggctgtcttatgattgccgcgccaatcgcaacacgctgcttttgcccgccggataatgccgccggttttctgtcaagcagagattcaatctcaaggattcttgctacttctctgactctttgatcaatttcttttttcggaaccttacggattttcagcgagtatgcaatatttccataaacggtcatgtttggatataatgcatagttctgaaaaaccatcgacatatctctttcctttgactccaggtaattgcagagttctccatcaatccagagttctccatccgtaatgtcttccaatcctgcaatcaatctaagtgttgtagattttccacagccggaaggtcctacgaaaatcacaaattctttatcatgaatgtctaaggtaaaatcttttacaccataatgtgtggaatcaaattgcttacagacatttcttaacgcaatttcagccatctttttcctccttcatagccacgaatgtggcttcgttcttgctcttatgtccgtgaaatatcataacatttcagtttctgaaagtgctatcatatttctgctaaagaaatgttaaatggacgtatattattatatacaaatgtaaaaaaatgagacagtccgcaaactgtcccactaaaatttcgttataaaattataggtataaatattatgctctcttccgttcttccagtgttctggatatttcttctgtcttttcatctgttaatatgtaatgttttcggaacacaagtaatccgatcagcaatacaagaatcggaatgatcgtcatacacatccgaagtcccagcctggaagccggtgcgattaccgtcagtacttctgccgtttcatccttcttgatctggaagatctgaataacgatcgaagccgcaagtgcagccacgccagatgccagctttaccacaaaggtctgcatcgaaaagattaccgattcgtcacgccggttatttttcaattccccgtaatctaccgtatttgcaaggaaaatcgtcacaataacattcagcataccaattgccgacataataaggaatgccggaaccagaagcagatagacaccggtacttccggagaatgcaatcacaagaaggatcagatatcctgcaaatgccatagaaaagctgacataaaaaagatttatcgtattcataaatttccggaacagcggaaacaaaatcatcatcgcaaggatctggaatgcaccgccaaaggtattaaaaagcgtataattgctctgccatgcttccggactgaaatcatatttgaaaaagtaaatgaccagattcgatgtaatatataatgcggtattgatcataacaattgccacaaccatggtcagtgcctggtcattgcgaaacagtgcccggaacatttcttttaccgttgctgtttccatatttaccgaagatttttctttaatagaaagacaggtaatcgtgataaaaatgaaaaacaaaaccgcaatgatcagtgcaaaatagcgatatccaagccgttcaatttccgatgcactttccccgcctgccagtttgccaagcgtggatacggaaagtacggtgatgatcgtgataattgcagaaccaacgccggcacaggaacgtgccattgcagaaagattttcgcgctcttttccgctttcggtaaaagcaggaatcatggaccagtatggaatgtccatcatcgtataagttacgccccagagtatgtaggttatagccgcataagcaaccagtcctctgcctgaaagagagggcggtgcagcaaacatcagatacaaaacaatggcatttgtcagtgtaccgataaagagccacggtcggaacttgccccatctggttttcgtctttgctacgatgattcccatgatcggatcattaaatgcatcaaaaattcgggcgataaacaggatcacccccattgccacagcactgacacccatgatgtcctgataataataaaggacataggacgctgacagcatatagaccatatctttccctacagccccgattccgtaggcaaacttttcttttccttttagtttctgtacttctcccataataaattcccccttgtcagattgtaatgccatcgatcagaatggatacgacttcatctaatgcctcatgataagaaattccattctggaccagcacgtctctctgaaaaaactgttctaatgtggcttccatcatggtttttaaaattggaatctggatatttcgaatttttccttctgtgatgccctgttccagtaatgaaatcgtactctcccacccggtttccagacgggattttactttttcataaacttcgggatacctctcctttaactgataaagctgtctgagatcaagctcccgataaccttccggtaacacaccaagaattgctctgattttaccaaccgtatccagactcagatcttgaagaactttttgttcactttctttgatcgaggaaaaacaataatcaaccatctccagaaccaatgaatttttgtcagggaaaacagtatagattgtttttttgctgattcccagaagagatgcaagatcatccattgtaaattttaacccttttttctgaaatgccttgatggttgcttcgagaatattgccttttaaatttttatctgacacatcatcatctccttgtggaaactatttctcttgtaatagtttccttgattgtagcatctttgcgcacaaaaaaacaagcaactaaattcacaaaaatagtttcttgtttttggtaactttttaatatggagcgaattctttttctggcggatatattttgatttaaaactctcttggttgcaattttttttattttaaaaacagctgcggaattgcttccacagctgttgcgtgcttgaaaccgtacctctgcactgtgaactgacacaggttttttacagggtgatttaaaaatttaaattgtatacttttccaaaaatgtttctatgaacaagaacacataacctgataacaaataaccaataaacgatgacattgaaccataaccaaccgtctataagctttgttgaagatataccctgtacggaaattcttacttagatatccacatcaaacaacactgtctgattgtagcgatccagtgcaatctgcatttccataattgtattggaaatacgatcgtattcctgacggattacttccagatcatagttgatatatttatattccggtaccgatccggatgaactgaaggaattactatacacacgcattttcggaagccgcttgcgcatatcgtcaagaatagcttttcttttgttaagctgcgccattcggatcaaaatgctgtcaatgctcatctcctgattgccaacctgcacttttgcggtggcatttgtcaggttcaatgtatgtttgatagtaacaatcttcctgtcgatctcgtcaattgtatttgcaatggtcatataatcatattccggaatgaccggctcctcattgaccgcagccacataggtactggatgctgcttccttgtttacccagaatgctttatcttcctcaaggcttctcaacatcttgtttgcataagctgatgtaattttcttcatgatttttgcctcccatactgttctcttgcttacaatataaatgatgtaaccggattgctccattgctatgcaatttccgcaatcctcgaacaccatataaataatatctgttcctcaacttctgatttaattataattatatgatagctgtttgtcattcaaccaacagtttaaaactccacagaaagaacaaagaatgtgcgaagcacattctagcgcctgtggcggtcgcttgcgacatcttcattatacgccgcagtgcgcatcctgccggaggcttttattacataggaaatgaaatttcctatgtaataagaaatatccccgtcaatgacgaggatatcttcaatcgaagtatgtaataatctacttaaaataataaaattgtctatattgggtaacgatttgccggaaatccatttataaatggcctgcggattttcaaatccaaaagctccctggatttcccgaattgtatatcctttttccaagagtagctttcttatgcgttctccagtctttttcggctggattgacaaatacatgggttccatactttgtgcctccatgattcagaatcaagttccctgataacttatatattataacacagaaagcatcggatcaccagtatcagtctctaaaacaccagaaaatatatttacagatattccggatccacctgtttgccatcgctccagattctttccagatcgtagaacagacggttctctctgtcgaatacatgtacgataatatcgccaaagtccagcagtacccagcttccaagaccatagccttcacgctgtttgacttcgtatcctgcttttccgagtgtctcttctacattgtcaaccagtgctcttacctggctttcgttggttccgtttgcaatgataaaataatctgcaagcacagagattcctgcaatgtcaattacacggatatcttcgccttttttgtcagcgagtgcttcgcaggcaagttttgccatctctcttgactgctcgattgtctgcatcagtttttgtcctccttttcggaatcactgtttttcaggttcttataatataaaaatgtctcttctgtcgcaggatctaacgttgcacctttttcggcaagatatgcaagtgtatcttccagaatacggtaaagacatgcatcgatatctacaaatgcaagcgcacgtacttccggaagatttggtgcaacatctcttccaggctcaatataatctgcgatataaatgatcttatcaagcagagacatattcggacgaccggttgtatgagactcgatcgatcgtagaatctcttcattttctattccatattttttccgggcaaaaaatgcgcccagctttgcgtgcagaagtcccggatttttgtactctgcatcggaaatttcgatatgatttttctcgcagagcttaatcttttcatctgccggcacacattttgcacagtcatgtaaaagtcctgccgtcaaagcctgctccagattggcaccataacgcatggcaaggcagcctgctgtatgcatcacaccgatcgtatgatcataacgatctttatccaggtaccgttttacttttttctgcatcttaagtattgtttccgtcatgttcactcacctgatataatctgttcaaatctatataatctgcaacctttttcggaatcggaagatcttctgtctctcctcctcggatcatctgccggatctcactggaagaaaccggcatcacaggggtacggagaagccggatatcacatgcatacttttctttcaaatatgtgatctgacggcgcatttctttcggcgctcctgcatcatcccgatatgctgccaggatgaccgctgttttcagaagtctttccggacatttccaggtttccagattgaaaagagaatccgcaccgatgataaaataaaattcatcctgcggataagtctctttaaaatactccattgtctgataggagtacgaagtttcctttcgatccatttcataggtacaaagccggaaatacgggatctcttcaattgcaaggcgtgtcatttcggcacggtcctgtaaatcttttcgtatttccggatttgatttatggggcggattgccgtttggcatataccacacttcatccagatggaactgctggtatgcatattcaccaagcatcagatgcccgttgtggatgggatcaaatgttccgcccataataccgattctcataatctatactccactcattaaggaagaacgattttcttcttgtcgtcttttccctctttataaagaacgatttttcttccgataacctgtaccacctgggaacgtgtacgctctgcaaggatctctgccattccacgcagatcatctccacagttctgaagaacgtgaagcttgatcagttctcttgcttcaagcgcttctgcaacagctgcggtaagttccggtgttacgctggatttaccgatctgaaggatcggatccattgtcatcgcaaggctctttaaataagctctctgtttggaagtcataaaacttctcctttctgaaattatgttcttttctaacggtaatattcaaactgaagaccgtacatacggatagtatcgccttcctgaacacctgcattttcaagctgttcaaggataccggtttctttcaggaatttctggaagaaagcaaatcccttctcggaatccagattggtgtaaccaagcatcttttcgatcttcggtccttctactacaaatacatcgtcttctttttccacggtatatggaagatccatgtggatgatctcttcttccgggaaatattcctgttcaaatacgatcggcttgtcatccaacttctgaagttcattatttacatagtaaagaagatcagaaagcccttctccggtcacaccggaaatcgggaataccttgattccttttggctcgaactcatctctcagtctctggatcggatcttcatcttcggaatagatcaggtcaaccttattcgctgcaatgacctgtggacgcatggaaatttctttgttataggcttccagctcagcgttgatcttgtaaatgtcttcaaccggatcacgtccttcgatacctgccgcatccacaacatggatcatcatcttggtacgttcaacatgacgcaaaaattcatgtccaagtccgacaccttctgatgctccttcaatcaatcccggaatatctgcaataacaaatccctttgcaccttccagatctacaactccaaggttcgggctgagtgttgtgaaatgataatttgcaatctttggctgcgcattggttacacgggaaaggaatgtggatttaccaacattcgggaaacctacaagcccaacgtctgcaatcaccttaagttccagattcacccagagttcctgtgcaggctttcccggctgtgcatacttcggaacctgcatggtagaggttgcaaaatgcatatttccaagaccgcccttaccgccttttaagataatctggcgctggttctcgcccgacatatcggcaatgactttattggtctctgcttcacggataactgtcccttcaggaactttcaggatcagatcctttgcatccttaccatgacagcgctttttgccgccttcctctccgtcctgtgctttatattttgttttgtgacggaaatctaccagtgtgttaagacctttgtccacttcaaagattacatcaccgccgcgaccgccgtcgcctccgtccggaccgccattcggaacatataattccctgcgaaagctgacgtgaccgtcgccgccctttccggatcggatatatatttttgctctgtctgcaaacataatatgtcctccttatttatgactaaaaacaaggcttcaaacccaaaaagtttgaagcctctgttaaatctgcttattcagctactggatagatagaaacctgtttcttatctcttccttttctttcaaaacgaacaacaccgtcaaccagtgcaaataatgtatcgtcaccaccgcgacctacattgattcctggatgaatctttgttccgcgctgtctgtaaaggatgttaccagcttttacaaactgtccgtctgctctttttgctccaagtctcttagattcagagtcacgaccgttctttgtagaaccaactccttttttatgagcgaaaaactgaaggtttaatttcatcatggttgttacacctcctcgtatgtcaaatccatatattctctgtagttctcatcttctgcaatctcttccagaccaagaaccatcgcgtcaagcaaaagctttgcctcgcgagtcggattacctttaagtcgatagtcaatgagtcctttggattcatcggatacaaggcttgtacggtcatccgcaaatttctcaatggcattcaaagtattgatcgtaagtacggaaacagctgcgcagacaatatcctgtccttcttcactgaatcctgcatgaccatgtgctttgaaacctacacattgatgtttttcatttttataaatggttactcgtatcatataaccaccagcttcttacgcgttgatcttttcgatcttaactgctgtatactgctgtctgtgtccgtttttcttgtggtaacctgtttttctcttatacttgtaaacgataacttttttagcttttccgtcaccaattacagatgcttcaactgttgcaccttctactactggtgttccaactttaagctcgtcaccacttactgcgagaacctggtcaaaagtataagactgtccggcttccacaccaagcttttctactttaatgatatcgccttcggctactttgtactgtttaccacctgttgctataattgcgtacatatggcacctcctattatcattactcgccaactacggtgtctgatcaaatcaggacttataacctcgttgtgcggcatacctctgtattatacagtggcataccgcacaaagtcaacccctaatttgcgatttttttaattttttcgtaacaatatccgataatgtcttttcttgtgatgattcctatgaaattctgctggtcatcaatgaccggaacaaagttctgatccatcgctttttccatcagatcttccatattggaatcagcgcttaccggccggtaatctgctcttcttgcaatcttcgtgattgcaatgtcttctgcttctttcagattcaggatgttcagcttcttaagtccccagagcaggtctccttcggtgattgtaccgacgtatttaccttcccggttgatcatcggaatggatgagtatttgtggtactccatgatttccattgcctgtctgagcgtgtggtagtcatatacaaatgccacttctgcttttggcttcaggaaaaataatatattcattttcgtatcctctcttgtatgaatattctgtacaggggagttttccccaacacctgtactataccatatttaaggatcgaattgaagatttacagctgagtgttaacaaaaatatcataaattgctttgattgctgcttcaaagtcgtgctctctcacaccgatgataatatttaactcgctggatccctgatcgatcatttttacattgacatgtgcatgtgccagtgcagagaaaattcttccggctgtaccgcgtgtctgacgcattccacgtccaacaacagcgatcagtgcaagatcggattccagttcgatgtcatccggattcacggcacggtggatgcccgcaagcactttctgctcatgttcttcaaattcatcctgatgaacgaagatagtcatagtatcaattcctgacggcatatgttcaaaagaaattccttcatcttcaaatacaccaagaaccttgcggccaaatccgacttctgagttcatcattgctttttcaattgtaatagaagcaaatccacgctttcctgcaataccggtaattgtatacttcggctttctgcaggttccttctacgatcagagtacccttttcttccggtgcgtttgtattacgaatgttgatcgggattccttctttacgaaccgggaagattgcatcttcatgtaatacgctggcacccatataagaaagttcacgcaactctttgtaagtaattgcttcgattccttttggattcttaatgatacggggatctgcaatgaggaatccggatacgtctgtccagttctcatacatatcagcatgtgtggctcttgcaacgatcgatcctgttacatcagatccgccgcgggaaaatgtctggatcgttccgtccggacgtgctccgtagaatccaggaatcacggcacgctctacttttgaaagtctgtctgcaagtacctggttagtttcttctgaaaggaagttcccattttcatcgaacttgatcacttctgccgcatcgataaactcatatccaagataagctgcgattacacgtccgtttaaatattctccacgggaagcagcataatctcttccaatcttctttgcaaaattatcacggatggtggcaaattcttcgtcaagagaaagagtgattccaagcccttcaatgatttcctgatatctcttctgaatgtcagcgagtaattctgtaaatttcttctcttttacagctgcgccgtaacaacgatacagcatatctgttaccttggtgtcgtcggaaaaacgctttcccggagcagacggtacaacgtaacgtcttgattcctctgaaagaacgatctttcctgcctttttaatctgtactgcatcggcaagagagcttccgccgaatttcactaccttaatcatctgttggtattcctccatctctcaattcatgtattctgatctgcacatggcaaacctgcattttctgtagaaacaccgggcagatgtttctacacttatgtagttattactttattacgctgacgtgaaaaatgcaagattttcttttggaatctgttgaaaatcttgcattttgtctaatagaatttctttttttgaaaactttctatgcatgaattacatctgcaaatgtagcatccgctgcttttctcaaatcctccggtgcaagtgtcagttgtgcaccgattcttccggcacttacatagactttctcaaactgctgtgcacttgcatcaataaccgtcggaaaatgctttttcattccgatcgaagtgcatccaccacgcacatagccggtaagcggtgttaactcctttaaatgaagcatttcaatagatttttcaccaaccgcttttgcagccttcttaaaatcaatttctgcttcgatcggaagaacgaaaacataatgttcgccactttttccagttgtgacaatcgtcttgtaaacctgttcatgaggcagattcagcttgtcggcggtttcaattccgtccgtgaattcatcgcattcataggtctgatattcgtaagaaattttctttctgtctaaaattcgcattgcatttgttttgacttcttttttacccatgtaaactttcctccagtgtttttcggattttctttcgtgtaatttccaccagctgcagtttcgtcattccaatcacatttcccggatttggatccttctttaattccagctgcagatacgcaagaagttctttcttctcttctgctgatttcatgttgataaaatcaataataatgataccggaaatattgcggagtcggatctggcggactgcttcccttgctgcttcccggttgatctccggaaaatgagaattctttttcagacattttccggaattgacatcgattacagtcagcgcctcggttggctggatcaccagataagccccggatttcatccatacccgttcttgtctggcttctcggatcgccccttccaggttatagcattttacaagtggataagacggatccgtatacgcacggagaagcggaagttcatctggcatttccgtttccagataagtctgaacttctttatacaaagctccatcttctaccgtttcctctacaataatttccgtcaagtcttttttgtaaatatcccggagtgcctgtacgcacggatccggtgcactctgcagacagctgaagcaggtccgcatcttgccatattctacgattctgtgatagttctctgccattttgtcaatttcggcacggatctgtgtttcttctgcttccacacaatttgtccggaaaatcaatccgaaatcacagtctatatagtcctgtcccagcttttgcagttcttctttcctgacaccgtgaattttaccggatacaccaatggtacgattgccggaagtcagtactacatactgcccggtgaaatttaagttcccggtcacgacaggctgcttggttttcactgcttctttctccacctgaaccagaagttcatcaccgatcacaagtggcttctttccgatcttattggtgaaaaccggggtatattttccatccagcgcaaaatagcattgttcaccatttgcaatttcaacaaatgcgccaccgatattcggaaggattttccgtactcttccgacataaatttcacccaggcagtagctctttttttctccgctactgccaaagtgaaattccgttactttctcatcctctaaaagtgcaagcacccggcggttcatgcattccgtaaggagtacttttcgttccatctatacaatctccgttccaagcgcatccagtggaaccagaatcatcttgccctccgtgttttcggattccgcaaaagtttccagtctgtggtgggtaaaggtcactttctccgcatccataccaagatagcggacaaacgcttctgtgaccagctccggctttaagttctggacacttcctgctgccacacgcatataaatctttccgtcccggcattccagcttgtagatcatcggacgaatgtccacttctttttcactctttttcgtctttttgaccacacagatttcattctgcgcataaaaagcttccagcttttcagcaagatcttccggcagactgccattttttaccgaagataaatagtcggcacctgctacgattgacattcctttgcttttcttatcatccgggatctgcacaaagctgacgatctccatgccgtctaccatctgttcattcagccgtctgaccgcttctttgctggcgattgactcggtcaattcgatatcaaaatattctccgtcactggtaagccctacaccaagtggattagcgaaagacatgatcatatgcgggctgtaaccactggtaaatgcgatcggaatctcggcacggcgaatcgctttttggaaataccgcatgatatccaggtgtccgatgaacttcatcactccatttttccgaaatttaattcttgccttcaaagcagacacctcctccgtaacttgctgccccacagccggaacattttgcacggcagttcggggttacattcccttccattgcattcttccattctcttataaggaaagattttgtcacgccacaattgatgaaatcccatgggaagatttcatctacttcacgctttctgagattatagaaatccatgtctacacctgtattttcaaaggcttgcagccatttatcataatcaaaatactcatcccacgcatcataaatacagccaagacggtaagcctcttccagaacctttccgaccttccggtcaccgcgggcaaagacaccttccagaacggttacttcggcggtatgccaattgtagcgcagactcttgcggttcagctggttgcggaatgcttcctgtacaattcctgcacggcggatatattcttccatcggctgcatggttgcccactgaagcggtgaaaatggtttcggtacaaagaaggaactacttgccgtgatctgacattttccatttctctgatccttcggaatttcataataccggcgtgctactttatctgcaagaacagcaattccttccatatcttcctgagtttcggtcggaagtccaagcatgaaatagagcttgaccttcgtccatccaccttcaaaagcctgtccggctccatttaaaatgtcatcttccgtcagacctttgttgattacattacgcatcctctgtgttccggcttccggggcgaaggtcagactgctcttacgcacatcctgcaccttgctcataacgtccagagagaacgcgtcaatacgaagagacggcagggaaatgttgactccctgtgtgtggaactcatcgatcagaaaggtgacgatctcttccagttcgttgtaatcactggaacttaaagaacttaaggtgatctcttcatgtcccgtatttttcagcattgcacgtgccgtctctttgagcatgttgatatcacgcggacgtgtcggacggtaaaccattcccgcctgacagaaacgacatccacggatacagccgcgctgaatctccagaaccgctctgtcctgggttactttgataaacggaacaaccggctttaacggataagttgtctggctcatatctgctgcaactactcgcttgatcttttcttttgcatgtgggttattttgcaggaaagattcaatcgtgccgtcttctttgtaagtgacatcataaaaagaaggaacgtaaattccctcaatctctgctgccatttccagaaattcttttcggctttttccggctctcttccactttttgtatgcttccagaagttcatcataaaccacttcgccctctccgatatagaacatatcgaaaaattctgccagtggttctggattatacacgcacggtcctccaccaattacaaacggatcttctaaagttctgtccgcactgtgaagtgggataccagacaaatccagtacctgaagcacgttggtgtaacacatctcaaactgtaatgtgatgccaagaaagtcaaactccttcaccgggtcctgagattccagggcaaagagcgggatatgtttttcacgcatgatcttgtccagatcaatccatggagagtagactctctcgcaccaggtatcctcccggcggttgaacatatcgtacagaatctggattcccagatgggacataccaacctcatatacctccggaaaacacattgcaaaccgaatatctaccgcttttttgtccttcatgaccgaattgacttcatggccaatgtagcgggcaggtttctctatattcagtaaaatatcatcatctaatgctaatttcctcatttttcctccgtttttagttcttttgctcttaattctataacgattcacgccgtaaatacaagcaatatttacaattttttaactttacaactataccatttatttcagaaaattgcaaaataaatgaggtgaaaacagcctgtttttgctattaagtaacagaaagtgtagtttctgtactgtaaaagactgtatgagattatatgtaacagcttgatcttttataagatttttgttgcctgttacgcaatgatatgacatatatattgaataattattcattaaaatgtattttatacataattacgaatctagtcaataaacaacaaaacaatgtcctggaaaacacattgcaaaccgtatatgttttgcagtattccctttcattgttggaaaatctgaaataatttaaaaaattaaaaattaaaataatgcttgttttatggcattatgcaacaaaaactatagttctgttaccatgtaagaccatatgatacaacacacgattatataattatattgacgggcactatcttatttttagaaaggcatcacttatttttgacatatcaagttcttcgcttttatcgctcatatgaattttgtcatatagtgaatcgacatattttgtcataatgctgcttgtatcaattatgtctctttgatcgtcaatataaacgtcttcagtcatatctacagttgaatgtcctaataatttagagattacttttaaattattaatattctttttcaataatgtggcatatgtgtgccgtaagtcatgccagcaataatcatcaggatttatatcacataattcaaggacatgtttgaatgcgtgactgattttggaatctcttgataatggtcttccgtttgaattcacaacaacaaaatcaggtgtataatgaaaatttacatcattttgattcaagtaatcatacttattttttgccaaaataatttcatctaaaacgaactggggtatttcaacgttccttacagaagaagatgtttttgtttggatcaattgacttgtagccatttgagattcccagctatctccgtaaatagttcgtcctttttgccagataatatgtaattgacgattggaaaaatctacgttttcaaattgaagaccaagtgcttcacttatccggatgccagttgtagaacaaatcaacattaacagatagtaattaggttcttcttttttgcaggttagtaaaatattttgtaattgctgtaatgaaaaagttttgcgtttggtctccgttctttttttctgtcgcatctttgaacggattgtttgaacagcgtaaggtgccgggtttgcgctattatgttaaactcctttgctgttttaaaagaagaactaataacggcataagcgttgcaacgcaaagggttcgaagcaatagaatccataaatttgattaaatcagaggattcaatgttcgttatgtatatgcgtggcgatatcgattttagcaagtggttatatatcacgttccgataatttacgaatgtggaatatgctatttttttgacagataaacaatctgtctttttgttgtgctgcaaaatagacaaaagaaaaaacacatcatatttatcaaacaattgcaaatatgatgtgttttataattatgtcaaaattcttaacttaatgacattgctccacaagggaatctcttttactgttacatagtacaaggcatttcttctgcaatttgcttaacagtttcgatcggaatatcgaatttatctgcaatgaattcacaagttaatccttttcgtaatccagactgtacaattttgcttataccttcttctatgcctttttcgtaaattccttcacttaaattacacatcgtatttgcctcctccgcaagattagatgcttttgggaaatgatagtcattttcaaggattgtaaccaggtttggatttagatattacacttattcttttgtacagtctttagctttctctatcttcaaggtattctgcaagactgtaatacagttcacctgcaattccacgtatctgctctgcggcggtcatggaattcaagattgcctcctgctctgcttctgccgcagcaaggaaagcacggtcgattatattttccggaattgctgatatttgcacaagttcctcctcataaccggatgggattctgtttgcagtcgtaaatccgatcataacctctccgctgccatggcctgtgtaaccgccggttcgtgcgataccaacaccggttcttttcagaatccgtttgagctgacgacttgtcactggaaggtctgtagccagaatactcataatagaacctttatcttcttcagatgcagccatatcactcttttcctgcttccattccagaatcttcggaccaacagcttctccgttcagtacaaaatcttccgttgcaccaaagtttgactgaaccagaacaccaatggtgtattctttttcaccaatcgtgatcacgcgggatgcagaaccgattccccccttcatgccatagcaggtcgtaccggcaccagcacctacatcaccttcttcgaattcttctgatgctgccgcaaaagcctcacgcacttccttttcgccaatcgcccgtttctggatatgattgatccggcagtcattgcactcgccaacaaccggattgatactctgtggctcaattccgtccttacggctctgttcgatcacgacatcaaccattgcatccaaaacctttccgacatttaaggtattggtaagagcaatgggtgtctcgagggtccccagttcctctacctgcaccacgccagcactttttccaaatccattatgaatgtatgcagctgccgtatagtgcttggcaaatgcattgtccggtccaggaacgatcacggttacaccggtatgattttcttctgtcttcaccgtacaatgacctacccgtacacctggcacgtccgtaatcgcattcctttctcctgtttttactcttccgggtacaatcccaaagtcccgaatccgttttttccccattttggtttcctccttggattatgttgtatttttcaatacatgctggttatagtataacacatctccgttattgaaggatttattttttattttatgcgtctgactttcgtgatcatctcggtttttaccggtctgtgatagacaaatcctgaatgcggttcaatggtttcttctacttctacatgttccagtcgttcaatctcatcccagccatcgatccacttttccgattacagtgaaattaccattcaatctctcagaagcagcaagagtgatatagtactggctgccagaactgttctctggatctcctgccatggcaacaatcccccgttcaaaaacgattttggcattttcaggattggttttaaattccggttcgaccatgatatcgatctgtggatcaacaccatcaaaaaacagtggctggaggacaaatcccggttccagacgttcaatagctcttctgtcaaatattttcttctctgcgagctgcataacacttccgcaggcaatcggtgcgatttccggccagagttcaaagtgtatcacagcattctcatttacagttatttcgatgattggtttttgattcccggtataattgaatttaccatcatttttctcttccagcgctttgatcatatgataagtatattcattgtacggcatagggattccaagctcctttcccatccgcacaagcgcaccggagaacatatcgatttccgtatgacgtccggcatccagatcctgtaaggtagaatatctggctgtcggaggaactacgcttccgcgtccggatgaacttcctgttttactcatatcgattccttttgccttcgctaccatttccagttctctctttaatccatcactgattgctttcatgtggacactgtcgtggtaacatccaacgcttgtccccagaattgcctgtggcagattgttgtatacattcaggcgaaatttacaccatatctcctcctgaatgtactcggtcgaccggaaatgaatcccagtatctgtaaacaacgcttccaccgctctcacacgctcactgtcaaacggtgcagatggctctccaaaaataatttccagtgtggtcggcggatcaaaatgataaccatcatcctctttgtgtgaagccactttgatcagtgccggtaagacatgctccgtgcccactgttcttccgattatttcttcactgtcgactccattcatcaggctcatgaccactgtatgtccacccgttgttttttgtatactcttcaatgtaccttccagtgaaccgtatttcaaagcaaccaccagcagatccacattatgtgcttcttctggtgaccacacctccggatggtaaatcctgccattattcgcacatccattttcccttagacgatccgctctttctccctcggcaatcacgccaagccggacttccggtttctgtgaaagtccccagatcacataggagcctaccgcccctgcacctaaaactgcaactgattttatcttcatcttctatctcctttcgttttacggatactcatattctcattatacttttttacagaaaatagatctcttcattccgccatatgtatcatatattaacttgcgactccaatctttacaacaaagattttttattataacaggaacaaatatcttcatgtttttgcagaaaaaaaagagactcctcaagggaatctctcttcttatgatacttactgtacaacacttaattccttggttcctgagccataaaaatacaaatcattcgacaagaacagcttatcttccttgcttgcttcatttgttcccttcaacgtatctttctgtatatctgcgtcgcaatatgcctccggcacaacaacaaacaatttttctccattttctgatccattagaagtaacctctgtaagaccgctctctgctgcccaagctgttgccggagcgctgaaagtaagtccgaaaacaagtaatcctgctagaatttttactcctgtcatttttgctacctgtatatttctatatttcaaaatctgttgctccttcttacaaattctgtaaaatgcagtccttttagtcgaaacgcgacatttttattttactactctttgacaaaaccgtccatatttcattaaaaatatttctgataaaatttttcaaactcagagagtaatttctttcggaaaatattttggtaaaatgagaaaaaggaaatgtcctgacatattttacgtcagaacatttccctgtttttatggctttagataaactccggaagaacaaattatccttcgcttaatttttatttaaccagatatacttctgcattcgtcacgccgagagcaagtgcttcttcatggctgtttacatagacatcaatgtggtttttcttgatcgcaccaccacagtcttcagcagtaaatacatgtccgccgatgatgacttttgttccgtaagggattacactcggatccaccgcaatggtctgtccctcaatgaccggagttccggttgctgtgatcccgtctgctttgttacagcagatttcacatgcacagtaatatgtaatcgtaaaattgccaagatccgttccgtacatctcctgcgttgcattgacctcgccgattcctccacctgcgacggtataattatcgtccagaatccgggtcgcccatactgcatctttgtcgtaaacagttccgtaaataattccaacatcttcatttgcagcttcgatggtctttccatctccggcatacatcacaacatgatatacataaccgttctttgcatagaagatcaggtctcccggctgtgcgtcttctaccggaatcttggttccatactggctctgatcctcggcaacacgcggaagatcatatccgtaagccttgtagatctgctgtacaaatccggaacagtccgccccatttgtcagacttgttccgccccacacataaggattaccgacaaactgggatgcatattcaatcattgactggcggatttcaccactcggcgttccttcttttgtagaagtcagcgtataataaagagccttattatcttccggatccatgttttcatctgctaccgaataggaatcagctcctctttctgtcacctgtgctttggtttcagcatctgatttcaaatacttcttttccgcaaagcctctgacatctccggattctacataaacccagtctgaatcttcatctgcgagaatgtagcagagctctcctgctgtcattgtcccaacaactctggaatccgcattcttctcttcttgaatattcaggattccttttttatcggtatctagctgatcgcttaccagtgccggttctttatctgcaaccgtctgcttcaccgtcgcgcggagataggtatatgcctgattatcttttgcatctatcagtgcctgtgccgtctttgcggttccctcgattccggtatagtctttgttttctttggaagcttttaacctggcctgtgtctgatagacatccagaagttcctgtgccgcatcttccgtataaatttcagacgcctttacaaatcccctgacattaccggattccacatacaaccagccattgtcttcttctttcaaaatataaagaagcccgtcctgcgaaatcgttccgaccgagcggaccttttcttccatctgctgtgctgccaggtcagcagtcacttttgccgcctgttcttctttctgcttctgcagatccttctcagcctgccttgctgcttcagctctttttccagctttcagattggtctgattcggtgcctctgtctttaatttcgctgatgaaaaaatgttgagtccggtcagtttgatctgcgtagatttctttatgctttttgccgtttttgtacgtttcacttttttcgtgttgtatttttgattctctatatcgaatccggctttcagctcttttgcatctttttttgccgcttcaagctctgcttctttggcttcttcggaagtatctgccctgccatctgcagcttccggaatttcctcccgtatattgatcgctgttctggcaaatgcatattttcttgccacagtccagaaacggaaatcctctaccatctctggctgcttcacaatctgctgacggttgatcagttcagaattactgactgcagtttttgattcgttctgaccggctgcttcttctgctttgctgatctcctgtgtatggtcgatctcacttcccggaattgggtcggtctttgtagctttccggtcttcggaagaatctggcttatcagtatccggtgtctgaatcggatctttggaatcggatttgccggaatccgggctatccggattttccggagtgcctggtttttccggagtttctggtttttccggtgtctctggattttccggtgtatccggcttttctggagtgcctggcttttccggtgtctctggattttccggtgtatccggcttttctggagtgcctggcttttccggtgtctctggattttccggtgtatccggtttttctggagtgtccggtttttctggagcctctggaatttctggattctccggggtttccggtgtctctggattttcttgatttccaggggtgtccggtatgactggtgtctccggaacatccggtgtctctgtcaggcgttctcctgtctccggatccactttctgaccagtcgaggtatcttccagatagccggtttcatcattcagcctgactgctcctctttccatcattccccgtacataatcagatacactcacaaatacttccgatccatctgtcttttttgcctgcactgtattctctgccacaacggccgtttctccatcatcggcaaataccgccattggcgaaccaagagccattccaaatgccagaagacttgccagtgtctttgtcccgatcctttttgatataaatttgttcctaaacttcaataattgatcctcctctcgtaaatagactataagttgtatgttaatttttggagttttcaaaaaattcttcttcgcattaacaattgcattaataaaatgtatgaaacattaaatttaggggttccattcatcttttatttgattatttttaattatagcataaattctgatatgctaccctcatataggacaatgaaatataaaagtcctatatgggggtattttcatgttcagaaagagtaagatagaaccagtagaaaaagtaaaaatagtcgaacgctaccttgcaggagaaattggcatacagcaagcaggaaaagaattgggagttgatcatcatagtattcgaaattgggtttctatttatcagtatgatggaccaactggattactcaatcaaccgaaaaacaaatcttattcaaaagatttaaaaatatctgctataaatgattatcttaacggagaaggatctcttcaggatatttgcacaaaatacggaattcgttcacacagacagctttccgattggattaaggtgtataattctggtggaatattaaaaacatccactggaggtgcttacatgaaaaaggcaaagaacactacacttgatgagagattaaaaatagtaacagattgtcttgcaaatgataagaattatggtgcaatggcactcaaatatgattgttcctatcaacaagttcgcaattgggtaatacgatacgaaaagatgggtcaagcgggtctggaagacagacgtggacgtcgtatagcttctcttccaagcagaacacctgaagaagagctacgtgacaagatagctgaactggaaagaagaaatctagacctacaaatggagaatgatctgttaaaaaaagtcagagaactggaaaggaggggtcgctatctttaatccatcggttagccgaatatgaagccatccaaaaactatcgtctactaagcattatcccatagatagactttgtaaatatcttaatgttacacgttctgcgtattaccgctggggaaaatatccgaaaagtaataatgaacttcgaaacgaaagactatccactgaaatccaaaggattcatcaccagcatccagatatgggataccggaggattcgtgatgaattagatggacataaaggaattcatgtgaatgataaacgagtacttcgtatttgtaggaaatacgatataaaatcaaatattaaatggaaacctaagagttgtaccagaggagacagaaatcctgatcacatagcaaaaaactatttacaccgtgaatttcacgccgaaaaaccgaatgaaaagtggcttacagatgtttctgaatttaaatactacaacggaatagaagttcataaagtttatctgagtgctattttagatttatatgatagaaggattgtttcctttaaaatcagcgatcataatgataatccattagttatggacacgtttgatgaggctgttcgtcaggagccagatgcacacccattagttcattctgatcgaggctttcaatatacaagcgcacagttttatactagattaaaaaaacatcatatgaagcagagtatgtctagagttgcccactgtattgacaatggaccaatggaagggttttggggaattctaaaacgagaaatgtattataaacagcgttttaatgacagaagctctttgattactgcgatagctaattacatagattactacaacaaccaacgacttcaaaggaaactgcatgtaatgacaccaatgaaatatcatgagcaatatacaaaagcagcataaaatatcgccagccatagcatggctgacgatacaaaaatttattattttttattgtcctcttgacggggagcataccattcaaccatatgtggtgtttttttagtaaaaatacacaatttctacatttatggttccagttcatattactttgtcaatatgttaccttgttatgatctggatgattgtcttatccgtttcacgcattcccttctttgcaagctctccgatattgcggattgtattttctacaagtccgtctcctccatagaactgctttcctatcttctcttaccagttcccagtcataatatccggttggtactcaatctgtgacacgatctgtgagggcgtatatttccagattttctctcctgtataatctgccgccacaaacatcccaaagataagaaaactgataaacatccgtgcaaagaaactgcttccgccattttcttctgaagaatgttctccatataatcccctgtatacatgctgataccttggatgcaccgccgggatactgccttttctccatttttgacgtgacatcctaagcaactcctcgcggcgttcctgtgattcgttcattccaatctctcccttctgctaaagcatccaattaaaatgaatgtgcctcggtgtattctacgccgaacgcagttacttgcaacattcttctttgcgcgagtgcgcatctttggcaggtagttcttttcatttaccagaaagttctttcccaatttcagacaaacaaaaaggacatatacctctacctcagtatatgtcccacatcttttcacatatgcaatttttaccgttttgccatctcttccatgatgtcatcccaggtgatcccccgttctgccatcagcaccatcatatgatacaggaaatcacacatttcatatttgacttcttcctggttcggattcttcgccgcaatgatgatctcggcagcctcttctccaaccttcttcagaattttatcaatacctttttcaaacagatagttcgtgtaagatccttcctttggatgctctttgcgatccatgatcgtatgatacacgctctcgaatacctgctgcgtattgatttcttcatactgatcccctacgattggctggaagaagcaggtcggattgccggtatgacatgccgctcctacctgatcgacttttgcaagcagggtatctttgtcacagtcgatggtcagggatttgacatactgaaaatgtccggatgtctcgccttttgtccagagactctgtctgctccggctgaaataggtcatccgtccggttttcactgttttttcaaatgcctcctgattcatgtatgccaccatcagcacttcggacgtcttataatgctgtgtaacaaccggaagtaatccatcggaatttaatttaaattcggaaaaatccatcagactctcaaaggatgtcatacgaattcctttctggctgcactcttctttgaaatcagcacaattgatttttctctgactcacatacattccagaaagtcctttcacacctgggcattccaggatcttaaaaagctcttccttttccagtgtatcggtcacaaccacacacggaatatccgtaatatttacaacggaattcagatccagacggtgcataaatacaatctggctactgtaagtctggatcagatgctgctgcttaaataatgcatcaaagtcattcagtgacaccgcgatcttctcttttccaaaccgctttgccacctcttcgatcagtttctgtgaatccggctttgaaaaattcagcatggcacgctttgcaccggtgtagaggattttcttgacatcctcctgccgctttacatttcctccggcaaccatcggaatccgaatcacgcggttgatctttttcatcagttcaatggactcatcatgatcctggtccgtatttgacaggtcaaataccagaagttcatccgccccgttatcgctgtactcttttgtcagcgcgatcacatcttcagatacaactgtcgggtcatcaaaccattttaccgccttccctccaaggataaaaatgcagggaatcaatcttttataactcatacgagaaactccttttatctttttacagactgccttttgtagaccacacttctttcatccgtggttcttcggatacagccatatcaagcgcttttccaaatgctttaaataacgcctctgccatatgatggttgttgccgccatccaggactttcaggtgcaggttcattgcaccgctgtaggaaacagcatagaaaaattcttttaccatctccgtgtccagttctcctaatttgtcacaggtaaatgtggcgtcaaaattcagatatggtcttccggaaaggtcgattgccgaaagcaccagcacctcatccatcggaagcataaaatgtccataccgcttgattccttttttatctcccagtgcttttgcaatggtctgccccagcacgattccagtatcctcgatcgtgtggtggctgtctacctccaggtctccggtaactttgacagtcagatcaaaaagtccatgtcttgcaaagccggaaagcatatggtcaaagaaaccgataccagtagaaatgtcagtctttcctgttccgtccagattcagtgtcatctcgatctgtgtctcttttgtcacacgactgcaggatgcaactctgctctccatcttttagtcctcctcttcaaaacgtacatggatcgaattggcatgcgcagtcagctgttccgcttttgcaaagctttcgatatccttatgtaccttctgcagtgcttctcttgaataagagatgatactggatttcttaatgaaatcgtctacagaaagcggggaaaagaatttagcggttccgttggtcggaaggatatggtttggtccggcgaaataatctcccagtggctcgcttgcatattctccgataaagatagctcctgcattgcggatcttggtcatcacttcaaatggattttttgtctggatttccaaatgctcggatgcgatctcatttgccacgtcgatcacatcttccatcgtatcggcaagcagaatatatccgtaattatccagagatttggaaatgatctctgctcttgaaagttcttttaagaaaccatctacctgatcggatacctcatgtgccagcttttcacttgtcgtaacaagaattgcggaagcaagctcatcatgctctgcctgggaaagcaggtctgccgcaacatatctcggattagctgtctcatctgccacaaccaggatttcacttggtcctgcaatggaatcaatgctgacatgaccgtaaactgctttctttgcaagtgctacatagatatttccaggtcctacgatcttgtcaaccttcgggatactctctgttccgtaagcaagggctgcaattgcctgtgcaccgccgaccttgtagatcttatccacaccggcttctttggctgcaaccagtgtattcggacttacttttccattttttccaggaggcgttaccatgatgatctcatccacaccggcaacctttgccggcatcacattcatcagtaccgaagacggataaactgcctttcctcccggcacatacacgccgactctgtgaagcggagtgatcttctgcccaagaatggttccgtccggtttactgtcaaaccagctgttctgacgctgttttgcatgataactttcgatattgtcttttgctttgcggatgactgtaagaagtgtatcatcaacctgcgcatatgcttcttcaatttctgcatctgtgacttcaatcgtatctgcagtaagctctgccccatcaaatttggcagtgtatgcaaaaactgccgcatctttttcttcttttactttatctaaaatttcttttacgcttgcctcatactgtccataattgttcggacttcttttcagcagatcttccagcagatttttctttgtatcgctgttcagcttttgtattctcatgtgcattaagcctccctttttaatatacttctgagtttataaagaagttccttgatcctgtcattttccagacgcatgctgaccgggtttacgatcatacgcgctgataacgggcaaacctcatcgagaactacaagtccgttctccttcagggtggatccggtttccacgatatccacgatcacctctgaaaggccaacgatcggtgcaagttcaatcgaaccgttcaatttgataatctctaccgtctggtgtctggtattataaaaataatcctttgcaatattcggatattttgttgccacacggatcagttcgtgattctccagatattttttcgcatctgccggtccgcatacgcacatcctgcatttaccaaaaccaagatccagtacctcatgtactttctttcccgcttccagaatcgtgtcttttccgaccacgccgatgtccgccgcaccatattctacataggtcggtacatccggtcccttcgataagaaaaatttgagttttaattcttcattcacaaaaatcagctttctggaatttttatctttcatttcctcacaggtgatccccagttcttccagaagctccagtgtctgttttgcgagccgccccttacagagcgcaaatgtcaaatatcttgtgtctttcatcgtctcacccctaccctacaattttctcttcgccggtcatcaggttcaccatctgcacatctcctttgctgcgaagatacagcatgcttcctgcaagactgcgttttccataatccacatagaattccagcgacttatccgatgctttctgaaggatctgggtattcttgtccttccctctgaattccatggcaagctggattgcatccttcaaccgttctttatcatataagatcagggaactcttctcgccacttgagatctggatcttctggcgggaaagtgcgctcatcagttcatctactacgatcgcaaaaccgatcgccggctcttcttttccaaacttttcaaccaggtggtcataacgtccgccttttacaatggcatccccggtcccaaaagtgtatccccggaagataataccggtataatatccgtaaattccgctcatgctcagatcaaacgtaatgtactgttccattttgtagacagataagatcgcgtagatcttttcgagccgccggattgctttcatcgcttttttgcttggcgctacctttttcgcctcctccaggatctccacaccaccgaccatctctgaaagtgcagaaaatgcttttcttgacaccggttttgcatcagcctcttctaaaagttcgtctgcaccgaaaaagttccggttgttaatcagctcacgcagacgttcttctgtctcatcatcaatctcggattcctcgatcagactctggaaaaagtctacatttcctatactgatctgaaattcttccagtccggcattcttcagacagtcaatgacaagtgccagcatctccgcatcagcatccgccgcatccagtccgatcatctccgcgcccatctgggtactttcctttaatcgtccctgataactggaatgattgataaatgtattccccacatagcaaagccttgccggaaactcatcatccttaaataaagttgccgtcgcacgtgcgatctgcggagtgatatccggtcttaacaccagtgtgttgccgtctctgtcaaaaaatttatataattcccttgaaggaatggttccgatctcttttctgaatacatcaaaatattcatacataggagtctggatatcatgatatccgtacaaatgcagagtcttatgaagtcggttctgaagtgccagctttttggcgcattcttcatgataaatgtctcggaccccttcgggtgtatgtaataactgctccatagattgtaactcctcttttttgtttatttgtcactttaacatattaccatattaaaacgtgaccttgttgtattatacgaactttgacgcggcttgtcaagcctgcacactcagaagttctatcctgctaatctcttttccatgcttcttatctttcttcccggtgatccagatccttctggagcatctccagatatggaacgaatacgccctgccttagctgcataaaatattcctcatccagttcttcaaagcgtacgcttttccgtccgccctgcttcatccgatcccaaaacacttctatttcttcaaaacgcatgtaataaagcaggttttttgtactgtaatagataagaaaaaaggaaattccatcctgtttttcaaaatcccgcataaagttcatctggtgttcatggatattgtgtagtggaaaggtatccatactgcactcttttgcgtcaaaacatacgggaattccctgtactgctccaatataatcgaccgtactgcgctggtcaaaataggccagcgtgatctggcggtgatctttgtccattcgtaccggagtgatcggtgtcgggattttctgaatgagcgccagtccctgctgttgatagcgttcattcgtccggttaataaaatcctccagggttgaacctcttagccctcttgaattccaggttcccattctaatccttctccttttatgatggttgtaaatccttccggaagaggcgcggtaagctccttttccgatacctttgcaagcgcatcctctcttttcgggaactgcattttccatgcatgtaaaagttgatattttaacgcatattttttcctgaaaatagaattgacctttggattaccatacttgctatccccgatgatcggatgaccggtcgaagacagatgtgcacggatctgatgggtccgtcccgtgatcagatgcaccttcagaatcgtctgctgaccattatccgcaagcggaatatactctgtggctatcggctttgcctcgccttttgcttctttcagaattttcacctgattggtcatctcatttttcagaagatatccttcgatcttctgacggtcttttatcaccccatccacgatcgtgagataatattttttcacggtcctgtctcttaaaatctcgctgagctgctgtaatcccgcaaggcttttccctgcggttacaagaccactggtattccggtccaggcggttacagacagatgggcggaaagtagcaagctcagctagtttcagatcgccttttttcagcagataagcgatcatatattcattcagggaaaggtcagacggtgctgctttctgggaaagcatgcctgatggtttgttcaggatcagaatatccggatcctcatagattaccgacagccggatgctgctttccattgcccgtgcaagatctgccggaagctgcttttctgctcccggtgcccctgcgaatttctgccaggtatcatctgagagaaatacttcaacctggtctccttttgtcagtttttcatttccctgcgcttttttcccgtttaacttgatgttctttttccgcagcatcttgtaaacaaagctcatcggcgcattacttaaatattttccaagaagcttgtccagacgctgtcctgcttcatttgacgaaacggttattttctgcatgcttttaattcctcctgccttttacagtgaaatgtccagaaggagtcctttgatcatctcttcgtgttttcttgtatcctgctgttctacagaagcaatgttgttcattccctcggcgcgggtcagaaatgctttgtaatcatggaaaagcttgaccaccaccttgtcgaactggttttgcttcataatggatttgatatgctttgcggcatagtccacatccacttttttcaccggcacatagccacagatcgtattgttataaattgcaacagctgctaccggcattgcctttttctcactggtgatcacaagatcgtatgcaacggtaagttcttcggtgacagccgagatttcaagctcagttgcctcatcgatggaatcgtgcggcatgaccatgatcagattgaccaggatccggcttgccggaagacatccgagtaccgctactacagtgagcagattgagctttgtctttgttgtcacataaccggcgatcaccagtgcggcaaccagtccaaaagagacaacagcttccagtatcaataatcgttttcttctgcgcagataacctgcatctcctttttgtatcttcatcttgtctttcgcttactccttcgttattttctccatcactgacatggcttttaagatcattccgtgcggaagtactttggtagcagcttctgcccatttcattgccatgccatatacagaaacctcttttttgtatttggcatcaatgagcgcctgctttacaatctgtaccggatctgccatcacagcctctttcatgccaccgggcaacttccctgacacttcaaaaaacggggtgtccacaggtcccgggcagaccgctgtgacgaagattcctttttccttaagttcagctgcaaggctccttgaaaagctcagtacatacgacttcgtcgctgcataaactgcgaattttgcctgcgggcaaaaagctgctgcgcttgccaggttgatgatcctggttcctttatgcatccagggcagacaggtacaggtcatctcggtcagtccccggcaattcaggtcgatcatgcggagctgaagtttcttgtcttcctttgcaatctcctctactgtcccggtctttccgaatcctgctgcattgaccagcatacggatatcaggattctgattctccagccggtttttcacctgcttgtataccagatcctcttccatgtcccctgcaaagatccggatatagatcttgtggcttttcttgatctcttccagcttcttttcactgcgggcaatcacccagatttcgtccagttccttgtaaaaacgttcaatctgtctgacaaattcttttcccatgccggaggatgccccggtaacaatcgcaatcttcataagcggttctcctttctcctgtgactacttccgtttgtgtacattacggatggatttctttttctgcggtcttgatgaggactcacctctgccgtttcctgtagatgcaggctttgtattcttatgccctgcatttgaatttttataatttccgtttggctttcctggatttttgttatttccattcgggtttttgctctttcggtccgtgccgccatgagttccgccatggtttcttccgctgtatccattcttctcctgcattttttccgaatgaagctttctcggacggatcagacatttttcatcgaatcctaccagatccatacggtccgcaattcgcagtgcctccatgaccagatcataatttttcgggttccggtactggatcagtgctctctgcatcgctttttcatgcggattcttcggcacatacaccggcttcatcgtccgcggatctacaccggtataatacatacaagtggaaatcgtagacggtgtcgggtagaaatcctgtacctgctccggcatataaccgagatcccgcaggtattcggcaagctttaccgcttctttcatagtagaacccggatgggacgacatcagatacggaaccaggtactgtttaagtcctagccttttattgatctcttcgtatttgtgggtaaaacgttcataaaccgcattttccggcttgcccatcatctgaagaaccgggtctgctacatgctccggtgcaactttcagctgaccgctgacatgatactgacacagttctttgaaaaacgtgtcatccggatccgccagcagatagtcaaaccggataccggaacggataaatacttttttgactccaggtatctttctgagatccctgagaatgcttaagtattctttatgatctgcgatcagatttttacacggctttggaaaaagacactgtttgttcgtacatgccccgtattttaactgtttcttacatgccggcgcacggaagttcgcggtcggtccgcctacatcatgaatatatcctttgaattccggatcctccggaaatgtctttgcttcagcgatcagtgattccttacttcgtgtctgaatgatccttccctgatggaatgtcagtgcacaaaaactgcagcctccaaaacatcccctgttgctgatcagactgaatttgatctcccggattgccggaactccacctgccgtctcataagatggatggtaggtccgcatgtaaggaagtgcgtagacatcatccatctcctgctgggtcagcggttttgccggagggttctgtaccacatacagatgatccgaatagggctcaaccagccgctttccggaaaatggatctgtgttgcagtactgtctgtaaaagcttttggcgtacagaagcttatcttttttcatctcttcatacgattccagaatctctgcatcatacacactgtccagattcttgaccttgcagaccgttccatcgatataggtaatgtccttgatatccagtccggcatccagtgcctctgcaatctcaataatcgagcgttcgcccattccataagaaaccaggtctgcacccgaatccagaagaatggaacgcttaagctggttggaccagtaatcataatgtgcaagtcttctaagactcgcctcgataccacccagaatgattggtgtcttcttatatgtctgacggatcagattgccgtacacaactgctacataatccggtctctttcccatcactccgcccggtgtataagaatcctgctgccgtcttttctttgatacagaataatggttgaccatggaatccatatttcccgccgacaccataaatccaagccgcggctctccaaattctgtaatactttctttatccttccagtcaggctgtgcaatgatccccacgcggaagccatgtgcctctaaaaggcgggtgatgatcgcatgtccaaaagacgggtggtccacataggcatctccgcttacatagacaaagtctacctgattccacccccgttcttccatctctttcctgctgatcggtaaaaatccatgattcattataatacctcgtatgtctgattggtaatgtcttcatagctgtgaataaaatagtcggcaagttcccgctttttcgcatcctgtgggcgtgaaaaccagtcgtccaccgcgcacacacgcattcctgcatttttcccggcgaggattcccatcggaacatcttcaaataccaggcaggcagaaggctctgcacccagctgcccagccgccttcagataaacatccggtgccggtttccctttattcacttcgcagcttgtacagatcgtatcgaaaagatgggtgatctgccttgcctttaaaaattcttccaccagtttccggtcattgctggttgcgattcctgtccggatccctttctctttcagcatctccagaaattcctttacccctggctttagtgtgacctcttttgtatatttatccacagacatatcataccattcttttttgatctcctccacagtatgcggaagctccggaaaaatcttcaaaaagtactgcgctgtctcggtatagctcatcccttccattgcctcatgaaaatcttccggcggattcagatgatattttctgatataatcttcatctatcgctgtccacacccacatggaatctaccagagtcccatccagatcaaaaatgacagctttagtatgctctaacataatttttttatctcctcttcggtcagtgaccggtattctccctttgtaagtgtcttatccagaacaaggcttcccatagaaagccgcttcagatagattacttctttgccgactgcatgaaacatccgcttcacctgatggaaacgtccttcagtgatcgtaagctcgatttccgactcttcctcactttttaggattcgaagatctgcgcttttagtcggcgtatcgtctccgatatccactccatctgcaaatgctttcacatcagattcatctacctttccctgtactttcgcataatacaccttatccacatgcttttttggggaaagcaggcggtgtgccagttctccgtcattggtgatcagaagaagtccttccgtgtccttatccagacgtcctaccgggaacagatcatttctttttttatctgtgatcagatccagaactgtcttgtcccggtcatcttttgttgcggaaataacacctgcaggtttatggagcatataatactcttttttagcgtatccaatctgttttccgtcaagacttactttctgtgtggtctcatcgattttaagttccggttttttcaccgtctctccatcaaccataacacgtccgctgcggatcagctttttgatttcacttctggttccctgccccatctcggcaagatatttgtctatgcgcatcatgcagactgattcctccatccaggcagatatttgttcttcaaagttccgttcgtgacttttccccatccaagcgggaaaccgtctgtacagaccagatgccagccttttgccttagccggaattagatcctccacatcgatagtctcacctttcagataacgcatcagtcggtcatcatcagaagacaggttcaaagtatgcgcgtactcttccattttcaggttcatcgccagtgcctggctcggttcaaaacgctttttcttcagttcgccaaggagcagtccgcttcttaaaaatcttgcgcctttcagttccggaagattctccggcatatagtacacgcgctctccatggatatccagtctccacggcttcagatcccactttacatcacggaagaattcctccagctctgccgggatcttcttcactttctgttctgcgaccggggaagacgggcagattgcatcctcactctttttcagcagtgcgaggtaatgtccctcccctttcatatgatgtggaaaaatacggacagtcttagcaaaatccgaatcctttgacttggttacttccggcctgcccggtgcaaatccttcatatcctgcgatttcctgaatctcgaattccggatattcaccgagcagatattcgatcgtcccctcattctccagtggatcaaacgtacaggttgaatacagcatcatgccacccggctttaacattcttgccgcctgggtgataatgcttctctgcagcttcgagaaaaattccggtccatgttcttcccaggcgcgtaccatcttcttatccttacggaacatcccttccccggaacacggcgcatcgatcaggatcttgtcaaaataaccgctgaaatagcgttccagtcgtccaggttcttcactcatgaccagcatattgccgattccgaaaacttccagattctttaagagtcctcttgctctggagctgctgatatcatttgcgaccagaacaccttcgttctgaagcttcgctccaagctcggttgcctttccaccgggtgcggcacagacatccagtacccggtcccccggttctaccggaagacggttcgccggtgtcatcgcactcggctcctgcaggtagtaaagtcctgcaaaataatacggatgcttcgcaggagatatcttttctccatcatagtaaaaaccgttatcgatccacgggatcggtgtgatctcaaacggacagatcttcacaaaatcctccacagaaatcttctccgtattcacacgaagtccgtaatatctcggctcgtcataacattttatataatcctcaaattcatctccgaggagtgccttcatcttctcttcaaattcatttggtaaatttatcattctttcgtcctccatatcatttaagtatagcatagttagaaagaacaggaaagttttttctccccggcaagtcttaaaatccaatagggattgtagctggtttcttcgccgtccggatagagataaatccccagatgcagatgcgtggcaaacatccctttcgtcccctccggaccatatccggtatttcccataaatccaatgatatcccctgccttcacctcgtccccctcctgataacttccataagagtccagatgtgcataatagaaatatgcaccggacggtgcggtaatcccgatcctgtatcctcccttttccagccagcctcttgccgatactaccccatctgtcatactcacaaccggatagagaccggggatatctttcgatgccatcagatcacagccttcatgtcccctttttcctccgtaggtgcgctctcccatccagctgtccacaaaagatacctgatactgtggatgtttcggtgattccggaacaggaaaatagcggatatcattccaaagagctgtacagatcttttcaaaagatttccactcttctttttccgaccatttttcaaacagctctttttcgttatcctgtggaaacaggctgttttccagaaaataaatggcataaagtcttcctcttttttcatgatctgtcttcgcaagaacctgaaaaaacgcctccttcatcccaagctttctgaattcttctgtgcttcctgtttttaggttcaatcggttttttttagctttctcgttgatctgtatgcttgctgccacgcaaaaaatcagcaataaaaaaaggagcagaagcgatctgcgttccagtctttttttcaagatttctccatttttcttttattctattcacactgaatctcttctatgcacatgtgccccggtatatctgtctgcgttttttcataaactattgcaaaagaatacggcaggtatacacgatgaaaacaaaaaaactgtctgtgttttttctgatcggacttttccttctgatgcttttttccccggaaaccgttgccacaggtgccgcaaacggactgctgctctggtataggcaggtgcttccggtgctctttccttttcttcttataaccggtcttatgatccgcacagagagcatttccctgatcaaccataccctttctccgattctgaagccttttcttggcatttctgaaaatgcttctttttcggtggtctgtggatttctctgtggctttccagtaggggcaaaatcctgctctgacctgactgataaagggaaaatttcttctgccgaaggagaatacctgctttccttctgtaacaatgtcagtcctgcgtttctgaccgggtatgtggcagtacagagcctcaagcagcctgaaatggcgcagatctgtctgctttttcctatccttgccgcactgtgctgctcctttttgttccgcagatggtatctgccgcggaatccttttgcggtcgtagaagaacaggctgatcccagacaatttcttcctttttccgaggctcttgacgaaagtattctgtcagcatgtgattccatcacgaaaatcggcggatatatgatcgttttttcagtgctcatttcttttatggcagaactttcctttcagaatttcttctggaaattgttgcttcttcccggagtggaactgaccgggggaatccgcatgctctgtcagctggaccttacttctgaactgcggtttcttctcgttatggcgcactgttcttttggaggagtctgcgcgcttttccagacaaaatgcatgctccgatcccagaactggtcttttcctcgctatatagcagaaaagctgattaccgcaatggtaaccagcctgttcgctttttgctatatgaaattgttcggataaagaacttattctctctgtccctggtccgtctgtccggcttctccgccgaattctgcttccagtccgcgtgaggacttatccggaacttccagttctgcacggttgttacggacaacatcataacattcctgaagggatgttaccagactgtcatacttgcttgtgtaactgttcagtgtatgaccgatgatgctttcagcattggcaagaagatcatctgtatactgcactgccccgatacggatatcgttggcatcattagtcgcattatccagaatctgctgtgcctggtctgttgctgccataacgatctcgtttgcctgtgcgtatgcctgctgcatgatctcatgctcgcttaccagttcacttgtctgtgcatgtgcttcttcaatcatgctttctgctttctgttgtgcatccgcaaggatcgcatccttgttcgcaatgatcttctgataacgcttgatctcatcaggtgtcttcatacgaagttcacggagaagttcatcgatctggtctttattcacgataatctttgtagttgataatggctgaaacttacagctgtcaatgtactcttcaatttcttcaataatctgctcaatacggctgctcataattttgcactctccttcttgtcacagacctactgtgacatcttttcttttatacttttggcgacagtctccggcacgaactgggaaatatcccctccgaaagctgcgacttctcttacgattgtagagctaaggtaagaatacttgagattggttgtaaggaacatggtttctacttccggttcaagcttatgattcgtctgtgacatctggatctcatattcaaaatctgtgatcgcacgcagtccgcgaatcacaagacgtgccttttgctgtcttgcaaattctacaagcagcccgtcgaaaggcactactttcacgttgccgagatcttttgtcacttcctttaacattttaacacgttcttctacagaaaacaacggggtttttgctttattcatcaatactccgattataagttcgtctacaattttactgctccgggtaataatatccagatgtccgaaagttaccgggtcaaagcttcccggataaatcgctcttatcatgagtctactcctccacagatataaatacatgcatattggtcttgtatttcttttgtttgatcattaaaaaaccaagttcctccaaataagaaaaatcagtcgccaaagatgcttccacgatgatcagtgcatccttttccagcaagtctgattttgcaagataagtaagcacctctttttccagcatatggttgtacggtggatccataaacacataatcgaatttttctcttccatccagcctgcgaagtgccgaaaacacatcctcccggattacttccgcctggtctgcaagctgtgtctttttcagattctccataatgcactggatcgcattcggattgttttccacaaaaaccgccttttttacacctcggctgatcgcctcaatcccgattgccccgcttccggaaaaaagatccagaaatgtacagtcacaaagtccgtgtgcgatcatattgaataaggtttctttggttctgtcggttgtcggacgtgtctccattccttttaccgtcacaagtggtattcttctggctttccctgctatgactctcatcttatcgttctcctgatttatgatgtcagaaactactccatcattccaaaacatagggtgttttgtcttttaaccctgacaacatattatacttttttgtgattattttgtcaatttctccgcttgtattttaccagatacattttttatatctgtcttttttcagatacaaagctctacttttccgactccatatgtgcctgatggacagtgatctgctgatatggaatagcaatatgattttcatccagtgtcaacttgatattttccagcatccgccatcttgtcggccaatactcttcactttttacccaggcacggacaccaagcaccactgaactgctcccaagctcatttacaaagacattatgttccatactctggatgacggacggatcattttttacaagttcctgcaacagtttcttggcaaggcgcagatccgcttcatatgtaatatccaccttcagatccagctgacggtaatctttgtccgtcacattggtaaggcttgtgttggcaagtgttccattcggcacaatgatcgtcttgttgtcaatggtggcaagcttagtgtagaagatctggatctctttgaccgttccttcattgccatggctgtcttctataatataatccccgacaacaaaaggcttcaaaaataaaatcagcatcccaccggcaaggttggaaagacttccctgcagggcaagaccaactgccacgcctgccgatgcaaccgttgctgcaatcgatgcagattctacaccgagcgaattgataattgccagaaacagcagaatatgaagtccgtatttcaacagagaatccacaaactgtcttgcaccggtatccgaattggcgcgttccatggatgcccgcgtaatcttgcggatccagttgatcaccttatggcagatgatgaatatgagcagcgccatcagaatccggattccaaacgcaatcaggtccggacctttctcctgaatgaatttgttaaatccggtgattgtatccaccgtatcctgcacggtctcctctacctcacttcctgcggctgtctgtgtcaaaagcatgttttatccctccttcagtgcaataaatgctgcaagattccccctctttcctttggatgcgcgatgggaaaataaaagctccgggttgcaacaggtacacacattagtaaccgccatatgttccggtctgatccctgcatctgtgagaaccagttcatttgccttccagagatccagctggaactttccattctccttggcatagaacagacggtcatattcagactctctgaaatttgcgcggaacatatcgatcacatcttcactgacttcatagcattcctgacagatggacggtcccacacaggcaaggatattctttggatcacaaccgaattctttctgcatcttttcaaccgtcacctgtcccatccggttcacagtgcctctccagccggaatggctggatgctaccacctttttcaccggatccagaaacagaagcggtacacagtccgcgtaaaatgtcaccagacagatccccggtacatttgtgatcagtccatctacatctgtgtaatctttttctcttgtaacacctttgccggcatcttctcttgtcacgatccgtacgttcgtcgtatgggtctgatgcgtgcagaccatatgctccggcttcacgccgattgcagctgccattcttctgtaattctcgtccacatgcgcgggatcatcccctctggtatagctcaggttcatgcttcccaggaaaccttcactcactcctccaagtctggtcgaaattccatgttctacaagcccttccttttcaaggatcggatatttgagaaatggtacgccagcacttatgcattcgtcaaagatatgctcttcgcttttatattttaatcctattttcatctgtactctcccgtattgtgatatctgcaggcagccatctgcctttccccggtatcataattcatacaattccaaaatctccgcagtactcaaatgcatttttccgcaaagaaatcttattccccgcgattcctattacatcgaagcggcatggtatctctgtgcagccgttcttcatcagataataaacggccgctccggacaggcgcatctgtttgggcacagataccgcctccagagcagccgaaagccctcctgttttgcgaaatttcacctcacaaaagaccagatattctccgtcttttgcaacaatgtcaatctccgcataacggcagcggaaattatactccagtatccgatatccttgcttttccagaaattcacctgctattttttcatattttgtaccggtccttcgccggtttttttcattctccaatcgccttttggatctgatcttctacctgttctgacggatttttatacgaagtgtccgataaaacttcttctgtggatcggtgtcggtccaagcgtctgaagcgctttgatatgttctgctgatccataacctttgttggacgcgaatccatatcccggaagtaccttatcatactcttccatcagacgatctcttgttacctttgccacaatacttgctgcagcgatggatacgcttttcgcatctcccttgatgattggaacctgtggaatcacaacctccggaatggtaactgcatcatttaaaagcagatccggctcgactttcaaattgccaatcgcctgacgcatggcttcgtaagttgcctgcagaatattgatctcgtcaatccttgcaggggaagccatcccgagacctaccgcaaccgctttgtccataatctcatcataaagctcatctctttttgctgcggaaagcttcttggaatcatttatataaaggatctcgcactctttgggcaggatcacggctcctgcaaccaccggacccgcaagtggtccccttcccacctcgtcaattccacagataaacgcataatcagcatatttttcttcgtactgacgaatttttgcaaggcgctctttttcggcaagcagcttttccttctgctttctgtacttttccagaagcttttgcacaccggctctgtcatccgacgcatagaccttcatcagctgctccctttcggcatcctctgccatttttaaacggctgccgatctctttgatactttctttactcatgctttatcactccgattttgttgaacggataaattcttacccaggcacgcccgatcagcatatcacgggtaagtacacccacacttgccacacgactatccgagctgtgattccggttatctcccaggacaaaatattcatcatctcccagtttaatcggctctgctgcaattcccggatcttccatcacctctgcaccataatgttcatccagctttttgccattaatatacatatatccatcgatcacctgcacagtctcaccgggcagtccaatgatacgtttgatataataggtattctctgcatgctggtaaggaaatacaataatatcatatctttccggatcgcggaagcggtagctgagcttatccacgatcaggttatctccgtctgaaagtgtcggctccattgaatgaccgtctacttttgtgcgctgtccgacaaaggtgacgatcacccatgtcagcagaacaatgaccagaagatacagaagagttcctcccagtgatctccatatactctgctcctgctccggagcttcttccttgttgtcttccttactcatttgtatactcctttacaaattcaagtgtgatccttccgagtcttccatttcggaaatcatccagcagcataccagctgcttttgcggtatctaattcatttccacgcaccagacaatggcggctctcagcaattgcttccaatacgctgtagctgttctgcttttcgttgatcgtatatttctcagcaagaacacccggataagcatcctgcataaagctgatcagctccgccgcaagctcttccagattcatgatctcatccttgatcgacccgataaatgcaaggcgcagtcccacctgttggtcctcaaacttcggccagagaattcccggtgtatcgagaagctctacgttcttgtttagacggatccattgctttcctttggtcacacccggtttgttaccggtctttgcacaggcttttccggcaagtgcattgataaaagtagactttccgacattcgggattccgactaccatcgcacggaccggacggttcagaatccctctcttacggtcacgctctgtcttttctttacatgcttcctggattactccctgaatagacttaatcccaccgcctttacgggaattaaccttaactgccgaatatccttttccgcggaaatagccgatccactcttctgtctgcttctcatctgcaagatctgccttattgagcaggatcagtcttgctttattctttccaagttcatcgatgtccggattccggctactcatcggaactcttgcatcaaccagttcgatcacaagatcgatcagtttgatattctcctgcatcatccttttggcctttgtcatatgccccggataccattgaaaattcatccagtttcctccttctatttaccaagcagtccgaaacggtctttcggggaaaggataaaccatactttcccttcaatctcagaacgctttacatttccaatatcagccatccggctgtcttcactgctctcccggttgtcgccaaggacaaaatactcatctccaccgagaacgatcttctcactggcaatacctgtatctgcaattgcagtagtctcatacttttcattcagctttctgttgttgatataaatctctccatccctgatctcaacactttcgcccggaagtccgataatccttttaatataggaatgaaggttctcattcccctttggtttgaacacgataatgtctccgcgcttcggtgtactggcatcatatacaatccggtttaccaaaaccacatccccattccgaatcaccgggttcatggactctccgatattactgatctgatgcccgaaataccacacaaacacaaatgcgcacaggcagacgagcacaatttggaatacccatccaaatacttcgggaatccatttcaaattgatatgttttctatgctttctgtcaaacctaagttcttttctttttctatgtctcatctgttatcatatcctatattagcaaaagggacaagtacctgtcgtatttgtccctctttaagcatttactattttactaattctttaacttttgctctcttacctacacgatctcttaagtagttcagttttgcacgtcttactttacctttacgaacaacttctactttttcaacgtttggtgagtgaagcggccatgtcttctcaacgccgattccgttagagctctttcttactgtaaatgtttctcttgctccgccgccctgtctctttaatacagtaccttcgaatacctgaattctctcacggtttccttctttgatcttaccataaacttttacagtatctcctacgtggaattccggagcattttcttttaactgagctgcttcaatgttcttaataatttcgttcatgtgtgaacctccttcatattttgacgttcttaatacgcttttctatcgtatcagaggaccatctctgttttcatcacaacgtgctatatattaacacattattcttcatttttcaagtctttttctcgattttctataatctcttctgcaagttctctttctttcatggtaagctctgcgtcttccagaaggtccggacgccattttgcagtacggatcacggactgctctctgcgccatttctctacattggcatgatgaccggataaaaggattggtggaacctgcctgtcgtgccagatctccggtctggaatactgcggatattccaggagattgtcctgaaaactctcaaattcggcagatacatcattatgcagaacacccgggatcaggcgggataccgcatccacgatcatcattgccggaagttcaccgcctgtcagtacataatcgccggctgacacataatccgttacgatctcctccagcacacgttcatcgattccttcgtaatgtccgcacaaaagcaccagttcgtcttctttcgcaaaatcttctgccatcttctggttaaacggcttcccctgcggggaaagataaatcacacgtggtctctttccttccgggagggctgctttttcctgaatggcaagataggtctggtaaaccggctctgcctgcatcagcattcctgcgccgccgccatacggataatcatccacactgctgtgcttgttaaatgcgtagtcccggatattccaggcttcaatctcaagaattttattcttcacggctcttccgataatactggtttccagaccgttcatcaccatctccggaaaaagcgtcatgatatcaaatctcatattgttctcctactattctgtcgcttaaatcagtccgtccatcagatgaacagtcattttcctattctcagtatctacatccagaatacagtcatggattgccggaagaagcacctctgtgtgcgcctctgtcgataccacatagacatcattcgcaccggtttccataatatcttccaggacaccgaatttttcaccgtcctcagtgtagacatccatgccgatgatatctgccatgtaatactcatcctcttccagttccacggcattctcacgagatacaagaagcggcatctttctgtatttttcaatatcatttatgttatcgatccctttgaacttcagaatcacatactgtttaaaaaattttacaccttcaatttcaagaggaatctgttcttttcctgtatcaagaaccacatctttcagagcacggaagcggtttggatcatccgttgtcggaaatactttaacttcacctttgattccgtgggtagatgtgatcacgccaacttgcaggtaatcattttgttgcatactttgtcctttcttagcatataagataaactttacaccgaaaaagtctgttttagtcttttgaagcgactttttctccatccccagatacagtgaatctgtcattggcagcttcacttgcatactaaggtatgataaaaaacgcagataaaaataaatttacctgcgttttatttttatgctattgcataatttcaaccacgacttttttgtcttctttggccgcggctgcctttacaacggaacggattgctttcgcaattcggccttgcttaccgatcacctttcccatatcattatctgcgacatgtacttcgatcacggtagtcttgccttcctgtttttccgtaaccacgacgccttcaggattgtccacaagtgctttcgtaattacttctactaaatttttcatcactcgcacctccgcgaagcaacctatttttcaatacctgctgccttaaagatttttccaactacttctgtaggctgagcaccgttgtttaaccattttttagctgcttcttcatctactttgaatacgctaggatcctgagttggatcgtatgttccgatttcttcgatgaattttccgtctcttggtgatctagaatcagaaacaacgattctatagaaaggagctttcttctgtcccattcttcttaatctgatttttactgccattttactttcctccataaaacaatttgtatttataatagtttatctatatatcacgcatggtctgcggaatatatctcctttagaaaggcatcttgaacttgccttttttacctttcccgcccatcattcccgggaaagacttcatcatcttgcgcatctgctcgaactgcttcatcatcttgttgacttccgaaatgtcaactccggctcctgctgcgattcttcgctttctctgcggagtgatgatgtccggattctgacgttccttgatcgtcatggaataaatgattgcttcgactcttgccatcttctgttccgcatcatccgcatcgatatcgggcatcttgcctttgccaagaccacccatgccgccaagtccgggaagcatattcatgatacttccaagaccgcccatcttgcgcatctgtttcatactttccagatagtcctcaaaatcaaactgcgactttttgagtttttctgtcatcttacgtgcctgttcttcgtcgatctcttcgccggctttctcgatcaggctgagtacatcccccataccaaggattctggaagccatacgatccggataaaactgctccagatctgataatttctcacccatacccacataaaggatcgggcatccggtgactgccttgattgaaagtgccgcaccacctctggtatcgccgtcaagctttgtgacgattactccatctataccaatcttctcattaaagttctctgcaacattcacggcgtcctgaccagtcattgcatcgacaacgagaatactctgatgaacctcgaccgtgttcttaatctcctgcagttcttccatcatctcttcatcaatatgaagacgtcctgcagtatccagaataatcacattgttgccattcttttcagcatgctccagtgctgctttagcgatattcgccggcttctgattatctcccatggagaacacttccacaccctgcttctctccgttgatctgcaactgtttaatagctgcaggtctgtagacatcacatgctaccagaagaggcttcttacctttcagcttgaactttcctgcaagctttgctgtggtcgttgtcttacctgctccctgaagacccatcatcataatgaccgtcttctggcttcccggctggaatttaatctccgttgtctcagagcccatcagattcaccagctcgtcattcacgatcttgatcaccatctgtcccggattcagtccgctcatcacatcctgtccgactgcacgctcctgcacactttttacaaaatttttgacaactttgaagttaacatctgcctccagaagagccatcttaacttcacgcagagccgcttttacatcatcttctgtaagtcgtcccttacttcttaaattcttgaatacgttctgaagcttttctgtcaaactgtcaaatgccatgttataactcctctatgatctctcctgaaagctttttcactttctttatcagttctttttcgtcctgctcttcataattctcaagaagcagatcgatctcatggactttttttttcacagacatgaacttctccaccaaatgcagcttcgcttcataatcctccagactcttgttacagcgccggatcatatcatgaacaccctgtctgctgatccccgcatctcttgcgatctcgctgagcgaataatcttcaagaactgcctgttcataaatctctttctgatgttttgtcaaaagctcaccataaaaatcatataataatgtctgctttaaaatctcgtccatcacttatcacctgtgctatcatataacagattttcattggtgtcaagtattttttcttgacattcaagaaatttttctacatgcaggttcccatgtccctgtctctggtcataatatctgcccttttcacaggaattccacagtctgtatttaagttccagattacacatatccgggtatttctgcaaaaccagagccgctgccccggacactaccggagttgccatagaagtcccggttttcggaatataggcataagggctccgcaccggatacaggtaattgcaggaatagatccggttccccggcacggcaagatccggttttttaatacaatctccggtcggcccacagccggaatacttctttcccagttcttcatccgccccaactgtgatcaccttccggctgtttcccggtatcgtgacgctcccttcctttggtcctttgtttcctgccgccgttacgactaccagaccggcatcccagagccgttctacccagaacaggaacaattcatcttccggatccttcttatgaggaagagttccaatcgaaatattgacgatccggatcttcatttccttttgttttaacaacacgtaccggatcccgtttatcacatcccggatttttccaccacctctctgattcagcaccttgacagcaaagatctgcgcctccggtgccattccgctgtacaggcctcttccgctttttccatttccggcaagaattcctgccacatgggttccgtgtccattgtcatcatatatggttttcttcccctgtacacagtccttccatcccacgatgcggccgacaagatccgggtgctgtgtgatccctgtatccagaacggcacaaacgacgccctttccagtgattttgttacgcattgtatccgaacaccagtagtggattttccgtttcaaatctttcatatttaaaatatcctttttctattagaatattctttctgaaatcagatgccaatttcttcggaacttttttgaaacactgacatgcctccttacatatgatgaagtgtaaagaaaccttactggaggctatcaaatatgagtgaattaagtgcaacaaactgcggatgtggaaattctatggataactgtggatgtggctgcggaatgtcttcctgcgtatggatcattcttctcctctgctgctgtggcggatggggacgcaatggcgacggatgtggatgtggaaatgacagctgcctgtggatcatccttcttctctgctgctgtggtggattcggcaacggattcggtaacggatgcggtaatggatgcggatgtggaaacggctgtggcaacggcggatgcggctgctagttacgaaactcagatcttattcgttcagacagaccagaggcggggcaaattatatccccgccttctttatgttttgtttttgcgcttctcctgttgcttttcgtgttcctcttcctgctccttttcctttttctttcgcaaacattcttcatccacttcatagatcgcattcccatcaataataatccggctgctcatttaataaaatccttccattagttcttcctttgctttattatatgtggatctcatattttccgtcttctttacatatatatttataacgctgaaccgtggaggacatatggaaaagaaaccgccccttgtcatgacgccatttgacgagtctctcacgaatgattttctgcaacttgtcaaaatcattcttccctatctgcccgatcacgttcagcgtatagctggcatttatgtgaaacttacggaacttatgaatgccttttactgtttccaacctccttattatcataatcgcagagggcggctacgaaagcaggagaaagatccgggcagcatgtttgaagcagttgtaccctatctttctcctgaaaaaagagaaatgtttgattccttttccggaatatggcaaatgatggaaatgatgaaagagatggactttggagatcctgcaaatatggcagatatgatgaatggatttcaggcagcacaggatatgacggatatgatgagtggatttcagacagaaaggatggatgaaaatgaacgaatggatggagcatccggatcttgcgaatctggatccgctgaaacaggagctgatccggacagcagcgttgaaagccggcggcaagaacgggaaagcactggtcccggtgatgatgtcactgatcgccggtgcgaataaacggggaatccggtttacccctgatgagatttcgctgattctttcagcgatcaaagaagggaaaagcaaacaggagcaggcacagatcgaccagatggtgcagatgatccggacaatacaggcaggaaaacagccaccaaggtccggaaggcaataaaaattgccttgcccgacaatcaatgctataatgaacggcagaaatgcacttcaggaggagcttatgacaacgatcaaacttaccatagaatacgacggaagccgctatccgggcttttccacaaagaaaaaaagcaccagtatcgaatcaaagcttacactggcgatcagggatgtaaccggacagtccacacagctttttgctgccgtaaagacggaaccgggtgttcacgcaacacatcagattgtaagttttcaattagaaaaagaatctttttcagataatacagaactgttaaaaatgaaattaaacgcagctcttccggcggatattgcagtcacctcgctgaaaatcgcagatgaacgttttgtggcttctctcgcggtaaaaagctgtacctatacctgccggattgccacagatcctgccgcagcattattttcccgtccgtacacctgtgttgtaaccgagtctcttgacctggaatccatgcagcaggcagcgcagcttcttaccggtacgcatgactttgccgcattttcaaacggacgtaccaaaaaaagtacagtgcgcactgtagaaacgatcaaaattaaccgcgaagaccaactgatacagattcagttgactgcaaatagttttctccggcatatgccgcagcttcttgccggtaccattctcacagctggaaaagaaaaaaagacagacagaactacgctgactctcgctggtgtagaatcagcagctcctgcctgtccttcgcatgcattcaccctgacggatgtacagctccgttaatctatccttcgatgatcttcacataaaaggtacggtttcttggtccgtcaaactcgcagaaatacagatcctgccagatgccaaaaacgatctctccatcatggatgatcagcgtctgtgacggtccgaccaccgtcgtcttcatatgtgcatgcgaatttccttctgcatgctggtagaagaactgttctgccggaaatactttttcaaagccacacaacatatcatgcaccacatccggatctgcattctcattgatcgtaaatccggctgtcgtatgtggtgagaagatcacagcaatcccttctcttacaccgcttctttcgatgtcttcccttaccatttctgttacctttatcatttgctgcgatgcgtttgtcgcaatctgatgttcgtacagatgcatatgcacacctccttacttttccagataagcttcgagtctcggaagctctcttttcatcatttcatagccatgatcgtagaaagccatcagcttatcataatctttttcaagtctggataccggcttcatttccgggcgaaggacgaagatatttccttctttttccagcttttctatgtattcttctgtccggttatacatcaccggtcttcggatacaggtgcggacaagtgccggatatttgctgtacatcttccggtataacttaccgaccgctttggaagttagttttttgcggtagccttccggtctcgtcaaaatgagaactatttttttcagtcccttttcctgcacatgctttaccggaatagaatcggcaagtccaccatccagatacggaatcccgtctatatttacgatcggacatacaagtggcatactgctgctggcgcggcagatcttcatcagccggtcactgtcgttatcttcggtcatatattcggcatttcccgtaagacaattggttgtcacaatctcacaggtcattccatttgaaaaataagtatcaaaatcaaacggaaagagttcattcggatatttattgaatatcatatccatatccagaagacttctttcttttacgaaatctttaagtccgtaataatagctgtattcctttcctctgtggatcatacagtcccttgttctgccgatctgctttgagacataatcgactgcgttacaggaacctgccgatacaccgaccacgtatgaaaaatacagatctttttccatcaaataatccaatgcgccggaagtaaatacacctcttgttgcaccgccttccaacaccagtcctgcttctgtcaaaacactcgctcctttcgtcctaccatgctgtatatttcgtgtatgatttataagtataccacaaattctcccttatgttaatgcttattctcttgcgaaaattgtgcagtcatgttaccataatgaacgtaatgcaaaaattgaaacgataattctatttgaataaggagaatttttatgattagtacaagtaatatcaccctccgcgtagggaagaaagccttgtttgaagatgtaaatatcaaatttacagaaggcaactgctacggtctgatcggagcgaacggagccggaaaatctacatttcttaagatcctttccgggcagcttgagccgaccagcggagaagccatcctcacaccaggtgagcgtctttctttcttacagcaggaccacttcaaatacgaccagtatccggttcttgatactgtaatcatgggaaatgcccgtctttacgagatcatgaaggaaaaagaagtgatctatgccaaagaagatttcacagacgaggacgggatcaaggcaagtgaactggaagcagaatttgcaaccctgaacggatgggaagcagaatctgatgccgcatctcttctgaacggacttggaattgagacagagcttcactacaatatgatgagcgagctgaccggtgcacagaaagtcaaagtccttcttgcacaggcactttttggtaatccggatattcttcttctggatgagcctaccaaccacctggatctggatgcaatcgcatggctggaagaattcctgatcaactttgacaataccgttattgttgtttcccatgaccgttatttcctgaataaggtctgcacacagattgccgatatcgattacggtaagatccagctctacgccggtaattacgacttctggtacgaatccagccagctgctgatccgtcagatgaaagaagccaacaagaaaaaagaagaaaagatcaaggagttacaggactttatttcccggttcagtgccaatgcgtccaagtcccgtcaggcaacttcccgtaagcgcgctctggaaaagatccagcttgatgagatccgcccatccagccgtaaatacccttacatcgatttcaaaccgaaccgcgagatcggtaatgaagttctgatggtcgaaggcttatccaaaaccatcaacggggaaaaaatcctggacaatctttccttcacactgaaccgggacgacaaagttgcatttgtcggtggaaatgaatttgccaaaactgttctcttccagatcctgatcggagaaatggagccggatgaaggtacttataaatggggaatcaccactacacaggcatattttccgaaagacagtggaaaagaatttgacaatgacgataccatcgtagaatggctgactcagtattcggaagaaaaggatgttacctatgtacgaggtttccttggaagaatgcttttcgccggcgacgacggtgtaaagaaggttaaagttctttccggcggggaaaaggtacgctgtctgttatccaagatgatgatctccggtgccaacgtactgatcctcgacgagcctactgaccacctggatatggaatccatcactgcactcaacaatggaatgaagaagttccctggcgtacttctgttctcttcaagagaccaccagatcgttgaaacgacagcaaaccgtattatggaaatccttccgggtggaaagatgatcgacaagatcacaacttacgatgaataccttgcgtctgaggctacgattgagatgcgtcgacgagcgcttgatttgcctgaagataacttagacaaatcctaagaaaacccagtaaaatcaaggggttccggcattttcgaacaacgttcgaaaagaagccgaacaggcgaacatacgttcatctttgatgctattgctacagttcacttatgaagacgaggctgatacatatacctaaaacaatagatggaatgccgtcacacagcctcaaatacacacaagatttctctaggaaacccaaaaagggtttccttttttagtgcctgtttttcttacgcctactttttctatcaagttatcctctctccgggaaacagaaaaagaagtccctgtgctaccataaaaaaagaaaggggccttgcggccccggtaagttgaaaaagcccaaagttttggcgaacggacaggctctttcggaaagcgagcttctttgaaaactcaatgaggctcaaaggtggctcttgttgcttcgagtataccacactcggtaagacaggcctccttttccgaaagttcaaatgacctaagaggaggttctacatatgccacacaaaatgatgaattcgcagatagcggacgtgcttcacgataacaggttgtcgatcgaggcacgtatgctatatgcatacctctgctcattcgatgatggcgcaccaccctcgacctgtcagattatcaggcagctcggtatcggcaagacgcgattctatcgatatcgaaacgagctcgaagcgttcggactcatcgaggtcgagaacacgatcacgtccggcggcggggtcgcaaagttctctttccccgacaaaccggtaccgaccgcagaagccgaggagattttgatcaaccgcctgatcaacaataacaacaaagcgatgaatttcaaaaaggaaaggaatgatgaaaatgcaggggaacacaactgaaatcgacgagcgcaaccttttgcggcttgatgcgctactctcccacggatatggactctccccgcagctcgtgatgagatcaaaaggcctttccatcgaggcgaaggcactctacggatacctgagctcatttgccggcgcgggggacgcggctttcccgtcaacttcccgcattctcgaagagcttgatatcagcaagaaccgtttctacaagatccgcaaggaactggtctcatggggcttcatctcgatcgagaccacggcgacctctgcggggttaaggactgtctacacgctgccgcagaacccgatcgccatcaagacggaaatcgacgagattgcaaaccgacgcaatgaaatcaagagcagcttggtggcgaatctccataacgaggacatggtgagtcataagggggattctgagtctgagcgtcttcagcaatcagcaggtaacgagccttgtcgtcaatctgaagccaaggctcaaaacaggggctccaatctgaagccatgtctccaatctgaagacgagggttgtcttcaatctggcgacaagctatatatagatactaatatcaatccaaaagtatcaatagatagatccgccgcccatccttccgatgatgaaggtccaagcgactggaaagtcaccgagggaatgactgatccgactcaacgagatgacggcgagtcggatcgcgatgcgaatagacgggacgcgttagatgcggtgcctgacggcacctatgatccgctccctacggtcgctgatggatataccctttcaaattctgaattcgaggctttcaaccatctctgttccttgtccatcaagacggtaagaggagccgttcggaacgaggcagcaaaacagtatgccaagagactcggggaaggatactctcccgccaccatcgagaaggcctatatcgactatgcggaagcctatcggcagaacaacccttcaccgaggtttgcgaagcaactgtcagattggttcgtcaaaagcgatggtttcgcgtatttcgccaagaaacctgtaattcgaacaacgacagccaccaaggctacaagtggtcaagattcggatctcagggccgcaacggaggcaaagaacgatcggctgacacttgccgcgaccgatccgaccttcagggaccttgaggcagccgtttcgaaggcacggtcactctggggacatgcctgcatgacgtctgacgtggagaacgcaagccgcctcaaggaggaatggagcaaggcaacggaacgggccaacgagtattacgaaacccattgcacatcagcggtcgcgacagcttagacgatctgaaaacacgggggaacggaaaattgccacgttcccccgaccgtgcaagatgtgaagtggtagaatcttacaaaagatttctcaagaccctaccaaagaaaggagaaatcatatgagcagcaattaccagcagaaaaaaatgatgaatgccctaggcgctatcgatacaaagggcaacatcgtcctcgagcagttccaagacggcacggcactcctcttccagccgggcaacgcgcagccgttttgcgtggctacagactatgaccgcgcgacggcctcgtggtcatacggaaagtacttcagcgatctcggatgcgcctatgaggctgctgaccctgagattatcgaggacgccagcgtcagatgggtcaaggaggatatccgggaaaagctcaaagcacaggatatcgcaccgacagaattcaacgtgcagtccgtcatcatgggcgattcaaggctttgggaacgccctctcgacagagattttcgagacaacatgattgcgagcggaaacgacgatctcgatgcacgcgttgccattctcaaggagaacgggaacttcaagaatgttgacaccgcaatgccggtggaaagtcttgatgatctggaacaatacaggtctgatcgacttacggataaggtcacgtcacttaaagacagtcttgatgcacaatataaggcagatgagcgtggtcgcgttttcgaccgtccatgtcaagtacttgacgacggtgatctcgacgaacattaaatagaaaggagacaaaaatgacaagccgtgaaatggttcaagattccgccacacgcaatcagagaactcttgctgatgctgtcgtggctacaaatcgtttcagggagctagatgctcgctttaagtcgcacgatggaatggacctcgatccatcgacacctgaaatcgaatcgggatatgaattcaatcggcgctccatcgaggatgaccgtgctgctgatgaccgaaattccatttcggatcaagatattgattcacggctgtaatatgaatttcctgacgtatggtttgcagatcgcataatcattgcgtgttagtaccgtaggatgcaaaaggcatccagaagggatgattgataatggcagatttgggagaggaagcattctcctcacaaatgaaagtcgtcgcgactttcttgcggttgcttgaagagctcatgcgtaataagcagcaagacctccgctatggcaccaaaacgcaaaggcgaggtatccttggtcgaatgaaagacttcgtcggaggaatcttcaagaaagtctatgatggcacattcggacgcctgtcgcgtaatggaaaagattatggtcaacttgaccttaatgatccggctgttgcaaagctctttgcggacacaatgaagcaaatgggcatggatgcgatgcatgaagacaacaatcttctgttcagcacttccgatgttgcaaaaatcctggccttttccaagatggttgaacaagagctcggtaaaaaaatcgagcacgaaaacgatacccctgaaaaagagcaatctcaggagcacggacaagaccaggaaaggcaagccaatgcccgaggttggtctgactatcccgcaacgcccgaacagattgatctcacagctaccgttctggcagccgatgagggtgtttcgattgatgaaatcaagaaagatttttcggaaaacccgtcaatcggcgaattgcagattgctcttgaagcaaaaggccacgacactatggcaatccagcccgacctgaagaattacgcgaccccagaacaacgagcacagctggacatgctcaaagataagggcatcatcggtgaaaatgagcttatgcagcttggtaagtatccttctcaggacaaggcgagcgaagtgctcgaaaaccatgcggatgccgtaaaaatgctcgattccgatgaaatctcaaatcgagcggaagcaattcgcagtcacgatggaatggatccagattctcacaccaaacaggtcgaatcctggaaggaggatctttccgcgaaagtcggaaatgcattcgaggcatctcgtgatgcaaaaggtcaaccgaatctcaataatttcgctcttcagtgcaatttgcgcggcatcgccgtacagttcgccaatgatggagagcttctattcacggatgccaaccagcatcacaagcaggtccgcgccgacaacctcgatccgaaattctcccgtaacagcgaggctttcaaaggtcagaaaatgtcgaaaccgttgaagcaaaaacaggaagaaatcattaagagcacagaccagcgcaatcatgaacattcacgtgcccacgacagtcaggatcatggtgacgcgcatggctccgagaacaaagctaggtaaggtggtgctccttggcgtccaataaatcgaaaactccgggcccaattcaggtcgtggtagttctaatgttgaccgttcttgccttctacttcggcaatcggttcggacaagtctttgatttcaacaccatggagattaccgacggggcgctcgcgacggtcaattcgatcgtcgcggcgcctgccgctatctcaacggcatccgttcccatgctgtatgcaatcggactcgccattacggttctcatcgtctggctctacacattcatgtatgccggtaactatcgctatggagaggaagccgggtctgcgaaatggggcacccttaaagaaggagtcgccttcaaggatcaatcggatccgtcaaacaatcttctcttcacgaaaaattatggccttgccctgaaaaaaccgaagttcgacctcgaacatgaccgaaacctcaatgtcatggtcatcggcggttccggctctggcaagacccgtaactatgtaaaacctaatctcatgcagcttaatgcaagctactttctgaccgatccgaaaggaacatcccttccagagtgcggatatcttttcagggacaacggttaccgcattaaagtgttcaacaccatcgaattcaataaatcgatgcattacaacccacttaaatacgttaagacagacgcagacattctttcctttgtcaactgcctgatctcgaataccaacggagacaaacagtccggtggagatccgttctgggagaattcagaacgtctgctctataccgcgctcatcgccttgttgagagactggttcccaccggaagattactcgctggacggattattgacgcttctttccatggcagaagccaaggaaaacgatgagaatttcaaatctccgctcgacatgatcttcgatgagatcgagacgggcaaagtttacgaaagaaatccgttctaccaaggcccgtcgacctcaagctcctatgcagacgcggaatcagaccgaatggcaatcagcgagaacacgaccgacgagttcacttggcagtcaagcctcatggagcgtaacaatgacggactgtctcctgcacgtgaaggcggattgacgtccgatcaggatttcgcattggcaaactataagatgttcaaagtagccgccggcaagacgctgaagtccatcatcatcagttgcaacgtgcgcatggccccgatgcgaatcgagcaggtgcgcgaactgttgaaatacgatgagatgaatcttgacgagatgggagatcccggacaacgtaccgctgtcttcgccatcatgtcggatactgacaaaaccttctcgttcctgcacgcaatcatgatgtggcaatcaattgatatcttgtgtcgccgagcgctcgagaaatacaacggcaaattgcccacgatggtcaacttcatcttcgatgagttcgcaaacataggaactatcccagatatcgagcagacgattgccgtcactcgttctcgtaacatcggcatttcaatcatcctccagtctgtcgcacagctggaaagccgctacgataaaaaggcaaaaacgattatcgattgttgcgataccaccctcttccttggcggcaagtcgaattccaccaacaaggaaatctctgagatgatcggcaagcagacgatcaatcagaagacattcggcgagacgcgcggacagtccggttcaagctcgaaaaacattcagatccaaggtcgtgacttgattgatgccgccgagatcggcaagatgaatcgccgcgaggcaatcctgctcatcgccggtacgaatccacttaaagatttgaaatacccggtcgagcaacaccctaactacatctatctcgacccaggtcgaaacaagccaggtcaggtcaaaaaccgctgtctgtacgatgaaccgttcaatatcctggagtacatggacgaaattaggacaaaagacgatacctacgcgtcataaatcacgcgtttggtatacactgaatcagtgcaaccgacacggaaaaaaggaaaggaattgaatgggtggataaacttataagaatttttgcccagccgataggtttcgccggtactgcttttggcattgccggcctaatctatctcggcatctcattggcaagcggtggaaggcgccagcctgaaatcgttaaagccattgcaatgatcgtagctggttttaccgttgcagcagcaatggcgctctatggctacaccgggcattaagctcatggaaactcagaatatttaaagaaaggaatttagcgtatgctctctcaaatcatgactaagatttccggaggcgtcacctttctcggcggcgtcctcatcgttttcggtctcgtcaatctcggtatgacaatcaaagacggtatgcaaggcggtggcggtcagctcgccggcgccatcgccatgatcgtcggcggcggtatcgtcatcgcagcctccgttttcctcggcaacttggacaccagtttcgctggctaaaggaggaaatgcccgatgcttagcgttgcaattcataaggatatcgccgaatatcaaccgaaagtcatcggtaaacttaccggtcgtacccttatctcaatcactgtcgcattagggctttccatcgctgtcgccgtctatatgaatctcgttttgaagatcgatccgaccgatcacctggagttcatctatgcggtttcactgccctgttggtgctgtggcttttggaagcctcacgggctgccattcgagcaatttgctctcctttggctacagcaccagctctccgataatcggcttttttacaaaccgtcaatgtttaagagcgggttcgtgaaaacgccggatgagatcacgcaaagcaggaaaggaaagctttatgacaaatcaaccagaaagttccttgatgggacaaacggacttgaagcctacagcccaagggcaggtcgagtcatctattaacgatacaatcaattttatcatggctaaggttgccgctggcgaaatcgacgccgccacggcaaccgaactgattgctgccgcccgcaaggattatgaaagcaacgttccggtgaccacatctgcccaacaggccgtgcaaccccaacaaactgcgaatccctatcaagccgatcctcagactgcatacgctgtacctgagatggaaccagaacagactcctattgattatggacagttcgctacttcgacaaactatccacacacctacgatgtcgaagattcctccgatgtcgatatggatgcactgagcggtattgccagcgatgtgttcgataagcagcctcggaaaaagctttcccgtaaagaaagaaaagcccgggctaaggaaatgaaaaaactccaaaaggagtcgaatgccaaactcaaggcgaatgcaaagagcaataagtccattcagaagcagctaaaagaccgcgataaggaactctcgaaaaagaatgaatttgctcgctacaggcgcaaaaccgcaaaagacgtcacttcattcatcgggtacaatcgcatgtatgaagacggcatatgcgaggtcgaggagggaatgttctcctcctgcatctgtttcgaggacacttcttaccattctgttcgcgaggatgctcagaaagctgtatttacgtcgatctgccgtctctacgaccagtttggcgcggacacgcttgttcaattcaatatcatcaacacaccgctgctcaaggaacagattgggcatcgcaagttcttcaatccgagcagccaactgaatgtaaacgccgcaaacgatgccgccgtcttcaatgagatcttaaatgagaagatgcggcagggtgtttcgaacatccggcgtaagatgtatatcaccttttcggtttccgcccccacggtggacgatgccgttccgaaactcgcccgtattgaaaatcagatctcgcagattctcacatctatcggttcaaagagccatgttctcgatggtgcggaacgactggcacttctgaatagtcagctcaacccactcaagccatttaacttcgattatcgacgggatatctccgctaggatggtgcagacgacaaaggattgtatcgcaccgatgacacttgatttcaagccggaaggtcttgccgactgcttcaagacgggtgatatgtggggacaggttcttgttatcaagaagcttggttcggaactaaccgatcaagcgctttccgatatcaccgaactcccgattccgcttaatgtcacttggttcgcacaacctatggataaagcggctgccgtcgctttcacgcgacagcgtttggcttggatcgataaggaaatcatcgaggaacagcgctcggcagttcagaaaggctatgacttttcaatccttccgcaggagctcaagtactctaaagaggaaactgaagacgtcatcgataaccttcagaacaaaaaccaacgtctttatgttttcacgggacttttctatacatacgcaccgactaagaagcaactggataaccaggtgctttccatcatctccgccgcccgccaaaactccatcgaggtcagcacctatgaataccgacagcggcaaggtttcaactctatcttgccgttaggtcacaaccactgcgagatctcccgtatgtccacaactgccgaagtctccatcctcatgccgttcgcaacaatggaactggatgataagggcggcaactattacggccagaacaagcactcttctaacctgattttctgtaaccgcaagctcctcgcatcaccgatgggttttgtttgcggcaagaccggtagcggcaagggcatggccgtaaagaccgagatgaccggtacgattctcagcaacccgacagatgaaatctatatcatcgaccgtgccggcgaatatacgggtatctcaagtcgctacggcggcgtgacttacaactttgcagtcgattcggatacctatctgaatccgttcgataccgtttccgtcgaaagcctcagcccggatgcccagcttgccttcaagatcgatgccatgcttgcccaagccggcgcttcggccgccgaagcaggccgtgatctcggtgaggaagaccagtcgatcatcacgcgttgcgtacaggaggctttcttcgacgcgcgtcaacgcggcgaacagccgcccctccttgaagacttctacaacaagctgcttgaacagcctgagcctgaggcaaagaccatcgcgctgcgttacgagcgttttgtcacaggtgcccagtccttctttaaccatcagagcaacgtcgacttcaagtctcgtatcgtggatttcaatttgaaggacttgccggactcgatgctcgtcttcggtctaatcaacgtctgcgaggcagttcgtaatcgtatgtacttcaatgcgaaacgcggagtgcgtacatggctgtatgtcgaggagatgcagtccatgttcgcttacccgacggtgctcaactacttctctcgcttctcgaatgagggccgaaaattcggacttttgctgacaggtataagtcagaacgccgtggcaatgttgaagaacaaagctgctcaaaatcttgtcctgaattccgacttcctgctcctgcttaaacagtctccgctcgatcgtgccgaatgggtacgcctgctcggtctttccgaacaggaggaggagttcatcgacgaatctgtcgagccgggcgacggtttgcttatcgccggcggtgcgcgtgttccgattcgcggtaaattcccgtccggtaacgtactctatgacctcttctcgacgaacccgaatgaggctgccgacaagaagcgcatgcaggaatttgcagcacgcgaaaaatcccgccttgaataaaattagctgaaaaggaaaggagctgacaagatgagagcagacgatttcgtcacaggtgattctgcaagaggagctggacaaagctctcttgttggtaccgaaacaacgaatgcagtcaacaccggtcttgtcggctccgccactgcaattgccaaaaacatggtcatcggcggcactgaactcggtgatgtcgacaagatgtatcaaactggcaaatcggctataaaaggatctgtaggtgccgcgcgtgtcggttctgaccttgtgaaagacaccgttgacacggcaaaaacaacggctaaggcttttaaagcagggcttaacggcgaggatatcgatctttccggaacaaaatcacgttccggaagtaatctggcgaagggtacgaaaaaagctgccaaggaaggatttcgagccgcaaagcgtgccgccatcaaggattccgaacttgaggatgtggacaacctttatcaagaagcaaaaggattaagcaaagcggctgtcagttctacaaaaggcgcagtcagcaatacccgtaaatcttggaagatgctaaaacgctcaaccgcgcgaattaaagccctttcgagaaaacgattcaccgccggcgccggcaacaagttcaaccagcagatgtatcggtatatgcgttcagccgcgtaccaatctgtttccaccgtcggtggaatcatcaatacagcaaagaacgttctttcttatgcatactggagcgtacgcatggcagcaaatggcatcggcgcaattttgggtgccttgttcggcgccataggtgtgcttattattccagtgatcatcataatcgccgtcatttgcactatttctggtggaagtaaaggcgaaaatgcatccgtgggctctttgactggtgacgaggccacgatagcgcaataccttatcgacaagggtgtcgatcgcacccatatagctgcaatcatgggaaatatgttccaagagtcgggctgtcaccctactgccttgaacagttcatccggggcctatggaatctgccagtggcttggtggacgaaagactggtctggaaaaccttgccaaggaaaaaggcaaagatatatccgacctttccgttcaacttgactggttctgggaagaattcgccgaatcgtgttcgggatggaataaagcaaagtataaggttttttgtgcccagtccgatctcaaacaatgtgtctatcttttcagaagccagtttgagcgctgcggagaaagcgaagcggccgacgcgaatcgtttggcgcaggctcagcgtatctacgatgcactgggaaccagtaatggaactaacggaattgacggaaacggtcaggatttaaagaaagccaccagaaggcaaaaagacgtagttaatgccgccaatacaactaagtccccaggacagggatggtgtgctgcctgggtcacgaacgtcttccagagcgccggtatcggttactttgggggaaacgcttgcgatatgtgccgcgcttactgcaccagcactaacgttcgggatttaaaagttggaatgatcatcgctgacgtgtcacatcctggaacaggcgaggcgggtcgtctttatgggcatgtcggaatctatatcggcgataataaggtcatcagcaacgagggggctattaccatcaagagccttcaagaatttgtcggtttttatggaaagggtactggatgtaaatggggatggctcggcggcgtcgatctatctaaataaaaggaaaggaataaaagcatgcgagacatctggtttttaataacagaccataagggaatcgtgaaaatccttgcaatcctaatcgctattttctgcgtcgtttccatcggtgtcagttcttatacgtctacgatgaaagttcaggaacagcaagaacaacaggcgaaaaaaaaggaaaaagaaaaacagatcaaaaacagctcagtaaaactgaaaaaagaccaacagaaaaccatcgatgaatatgatgatgcaacagcgcaattttctgccttgctgtcctctaatgtctgggcaacttacagcggcaccggaagaacgctatatttcacagactcgtcaatcattatcgctgatccggaagctgatccatctaaagttgaaaagccctttgtcatcaaaggcctttcaactgaaaaggtcgatgtcggtgagatgaaaaatctcactaggtacaattgcgcctatgaatcagacgatgataaaaccagagtattgaccgtcgataaaaacgatgacggtacatatttcaagatgtctattgatgtgaaaaacagcggcacgaacgaggaatatataagaactcaagccgctggtacttttgatatcgacggcattagtgaagatatgtctgctttgcttggcgattcgagaagcatcattgaagattttctacgcgagcaatgtgctctctattatccgaccgcggtcgaagccgagtgcaacggtatccttacggccgacttcaacgctaacgaatatagggttgatttttccctgaaagacacggaagaccagcagcttacggggattactgtggtttaccatctgagcacaaaacaatgtgaactgatgtaaaggaggaattttatgtttaaaaataaaaaaatagtactttttctccttgttctacctctggttgctgttttggttgctccgaaagtagcccttgcagatgacgactccgattgggtcaaaaatatcccaatcattggcggcgttgttgactttgcttcggatccaggtggatggattaccgatcgttttgctgaaggagctgagttctttttcaatgatggtcttcaaaatatcaagactacttctacaaaatcgattcttggaaaatcattcaataatcttctgggcaagaaaacaggcaccttttacagcacggttagctttgttaataagtcagtcgtcatgccaacagcagcttccatcctaagccttgtgatgttgatacaattgataaaaatatcacagcgtattgatggaacagctaccttaccagcaattaaagacattgtctttttaattatctatgcgacgatcttcatttggcttctcaaaaactcattgaagatctgcgctggagcatatgatctatttaacgaaatgattggtaagatcaatcagtcgaccgttgatgaattaaaaactgtcacaatagccgattcttgtaaagagagttttggagcggtaattggtatatgggttcagagcatgatattcgatttgatcacgattatcatcaagggctcggtttcggtcatgtgttatatgcgagcaatgcaactatatgttatggctgcgttctcaccgcttccgtttgcgctacttggattcgacgaaacaaaaaactatggagtatctttctgcaagaacttcttagcgacatgtcttgcaggcgtaattattctttttgcaatgggacttttcccaaacctgctttcaggctttagcggaggagaaatatccggcttcaagggcgatatgtggagctctgtatgtgcatctgttgctctgatgctaatcgtaattaaatccggcacaatcgcgcgtgacgtttttggcggataacttattaaccagggaggtgtagcatcatgaacgatggaaatgataagcatgagggagcttggtggggaaatctcgaaactctgaaaccctctcaagtgcaatctgattacagttatgtagatgaggatgatcgacgtaagaagttcatcattattgcagccgttatcggtattgttctagtgctgctcctcggtggcgtgactgcttttaccgttctttcaagtaataaaggtcacgactcagatacaaagaaagaacaaacgcaaactcagaaaaaagagacctcgactgagaatgcaaagaagaaaaaatccgctgaaaagagtgctatctccgtcatggtgacagctgacggagctgctgaggattctaaggcttccgtttcggtttccgaaaagggtaagaacggaaagattgttgtcaaagatatttccgttgcagtcaacgacgaagtcaagatctgtactctgccgaaaggcaagtatttgctgaccgttgagtcggcaccggacggttatgataagccagcaaaaagcaccagtttcaccgtcaaaggtaatggggaaaaggtgtcagctttcgcttttttagccaaacatgtcgataagactgctgagagcagcgagtctgaagataatgttgaagcgactccggcagacgacggggcttcgcaaaatcagaataatcaggcagaaaattcttctgccgatatgaatcgtggtgcttccgctccatcgtctggcaacggacagccctcttctacttcaacgccgacaaccacgaagactatccatcatcccgccgagacgattaggatcgcgatctgcgacacatgcggggcggatatcactgatgatatcgaaggccacaagaagtcaaccggccatccgtggtaccactacgatgcgaaagtggtcaaggaagcctgggatgaaacggtgaccgtgaactagatgaaattcgcaagcgcttgcgaatttgaaagaaaaaacagggcacccgaccgaggtgcccttttccggtatcgaatggtagaatcttaccaagcatcaagacgcaaggaggtaccccgtatgaacgaaatgcaagcccacggccttttaatccccgtcggatcgaagccgttcgaggtttggatcgataagaataactcgctggccgaactgcaggacctcgtcaacggaaacgttgaagtattgagagttctcggtaatggagttgacctgtgggtcaatgatgaaggcctattcaacggcagccaacccaatcgtgccatctatgcgacgaagcatatggaggaagtcggatatctcgatcagctgacgttcggccatcccgtcaaggaaggggaactctattcgctaatctgcggtgatttcgtcgcattcggtgtcgacgaggaaggcgaaatcgcaagccttcctcaggagacgatcgacaagctgaaagagacctttgcggacccgtccaccggttacaaagagtatattcacattaagtacggcatcgaaccggatcgatatcagcttcagaatgagcacgccgccggcgacaagcatgagaaatctacgaagtctctcgccgaagtcgctacagaagccagggagagttcattagtactcagccaggacgagggcaaccacgacgacagcggtagcgatatcggcaattcgcgtccaatcgaccgtgagtatccaatcggtcactaaccagaactgtatgaatcgttttaaagaaacaaggcggtgaaatgatggaatccaacaaagtcaaaggcctgatcttccctgtcggtggggaggctcaggcctttctcgccgacagggacagaccatatcgagacatccgtgaggcagtccaaggcgaatatgacgaactcggtgccacgttcgccgatgtggatatctatgtgaatgccgccggtgcagacagtttgctaccaaaccgcgccatcaaccccgatgccttcatggatgactcgggcttcctgtctgaaaagagcctcatcgtcggaacaaacgacggcaagcccttctctctcattttcggcaatatcgtcgccctctcacgtgatgaaaccggtgagcttatcgatatgcctgccgatatcgagacggaactgaaagagtcacttagcgatcctttggacggatatgatttacggtttcgagaggccttcggcagatatcagaactgggacttaagccaagcccaggccgccaagatcgccggcttgagccaacaggcattctcctatcatgtgaacaagatcacgaatgcacaggatacccgaggaaggggattgaaaccccttcccaagggattcgaccgtctctacagcgagtataagaacggagacatctcggcaagatccgccgcgacgaagctcggcatcacgcatccgacgtttctcaaatatgtcaaggaatgcgatgtccgcctgcataaggacgacctcgtgcaaacccacaatccgcggggactcacggaacgccatgcagcggccacggatgcggcaaggaatctgaaccatgaccaggacgcacctgattcgccattacgggacagatagacggcacaaacacggggactcgccgcttcggtgagcccccgtgcccttccacacgataccttttgcagatgacatgccgtatccgtcatcgatatataggcgaaacgcagccaaagtggtagaatcttacaaaacacgccgccggaacggagggtaacatgcaaaccggaacgaagaagacccctgatcgcttccagaactacttctgccctgccgcagtcaacgatatcgtgcaccatgcctacgcatggatcgtcaaagaaccgaacatgcagccgaaattcctctactgccgcgctatcgacgatccagccaacgaccgcggatggaatatcatcgcggaggtctgggaacgcgatgttctcggcggatggggcatctcctcttccaccatgcatcccgaatttgaagacaccgccgacggatatgtacttgccgagggtatgcccggaacggcagcatcactgccttaccaggtattccgagaggtggtcaatgaacatgacacgaattacctgatcgccctcgccattgcaatcgatgccctgccgaaagattccacttgcgacatggcatctgaaactatccgtgcaaacgccgacatcgatatcgccgagcgccgcaagagtgtccttcccgaccaagccggcctcgctgccaaaaaggcgtcctgtatcgagtcgcttgcgcacatcggcggcaatgcgcccgtttgcggacaggatgaaatcacccggtaaaggagaaccgatatgagtgaaatcaagacgaaaatcagaacctacaacgacgtcatcgatctattcggcgaagagaaagctgccgatatgctaagcgaggcgcttgactggtcgacaatcgatccgaaaaacgataagaagaatatcatggagcgcaagccactcctcctcgatccgtatatgacatacgagggcgaggattactgcaagcatatcgtcgccggattcctcggtgaccgcgacctcgactgggcgagcggatatatcgacgaggagaaaatcaagaacggacaggtaatgccggccgacctcaagtcggcactctctatggcactcgacaacgagctgtctacatcctgggcctatctggatgccctttcctcccagtgcgcggaaatcttcaataaatttgccgaatatatcgaatctgccggccttgccagcggggtcctcgtgcccggagagtatgagttggattccaatgcgctgaacgcggacgtctccgagagattcaatatccagtatggattccaatgcgaccagatgatcgatgccatgcagttcgatatgacgctcattctgactgagaaggtcgacagcatggacggatacaggctgatccagagcgtatgcgactggcgcgaagaaaacctcgaggttatcgaggacgcagagaacaatttagattatggcaaagtgcccagctacgtggcttacgaacgtccggcggatatcggtacgacaatcatcgatgagctgtgcgcatcgcagggcaccgccgtcgagaaactggtgaactatccgaccactaaattcgaacgcaccatgcgggacgagcttttcgaggcattggcggtaaacgagacgactatttcccttatggctaaagtcccctcttccgtcttcctcgatgccgtggcatgcatggactcacgctatatgagcggacacacagtcgataccggtcatgcttttatcgtctccccgggaacatacgaaccgtatatcggtatccacgatcccgtctacggcgcgggttatatgatggtcgacctcgataaaccatttgaaatcccgatgaaccgtatctggatcgccatggatgactacagtggccctgagaccaaggagggtctgcgtggaatgtaccacagcccccaagatgtcagtgccttcagcgaccctttctgcggttccgtcagcgtcacgccgactcgcgatgagaaacaggaacctgcaaagagcggtctagaagccaagcgcgatgcatgtgccataagcgccgctcatctcgacagcccaaacacggaaatccccaatggcaagaatatggaaagggaatagccgattatggaatacaaagacatcaagacagcagacgagctggaaagctggtatgcggagaaggaagatatcctcgagggtcatgtccgcgattatgccgtaccattcggcaacgtataccacctggattccccaggctacgtttcagaagaacgttggtgcgatacccttccttctgaccgggaacgctcgaccttcatggccttgcagaacggtgtgtcgaccaaggagatcattgaacataaggatgagttcggctggatcgaccgcatggcgatgtcgtctgtcgccgatgattacgccgagtgctacatgacacaggcaggtccggattacctggatgaacaggaaattatgaacgtgcgcgaacagtatcctgagcttatcgactctaacggagagatcgtctggaacgatcccgatttcatgaagcgcggagtcacgttcgatgtggaaaactttggggagaaatataagctcgagctcgtctgcgacagttatctcgataacggcagcctttatgtcggcgcttacgacgtcacgacggaaagcgataatttcggagagcgctgggcagatatctccgtcaacctaaacaatccatgccagaacgacaggactgttttcctcgacatgaacaacctgtataacccggcaatcatcgaggctatctatgggctcggaaccgtggaaggcatcgtctcccattccggtttctgctcctatccggcattcacgtttgatgccgatgtgatctcccagatgcgcaacacgcaagaattcatggatgcgaatacccccgacgactataagctggtcgccgtgaaggtaggctataacttcgcgctcgttccgaagatcgagctctccggtatcgagacgaacgccaccgagaccatcgtcgatatttccggtaaacagtatggccttctcgccggcaggaccttcgaggattcgcagaaactcgatgccgtcctcgatgcatttccggagtacgcgattaaggactacaaggtaccaaataaaatcagcgtattcatcatgcctgtccagatgtactggaaggatgacccatctgagattatcgagacgaatttcagtttcgaggacacctgcggtcttgccatcgacgatagcgttacgttctccggctatacccagaatgaactcgtggacatgattggcagggaagacaacgggggagacttcgtcatcaccggtgtgggcgccgggcactatgtcggcacctacaaaaaggaaccgtctaaaaacaagagcgtttccgaaaaaacctgcaatgcaagagagtcgtcggggcgcctcgatgcgaaccgaaacgtcgacaggaacgatattgcaaaagacaaggaggtaaagtagccatgagcagcaacaaccccaatcgcgtctacctcgatacggagaccaccggcctgcatcccgaggagggcgacgaaatcctgtcgctcactatcgtagatgccaacggacggcttctcttcgatgagaggttcaagccgaaacacaaaaaggagtggccggaagcccaggcggtgaaccacatttccccggatgacgtggaacacctgaccactatcgatgcctatatggaacaaatctgccgcatcctcgaccgtatcgccgacgagattgttggctacaacgtagccttcgatatcggtttcctgaaggccgccggtgccaccatcaaccccgatgccgcaatcatcgacaccatgcaagaattcatggatgccttcggaaactcaaatacgggacatagataccaaccgctctccatggcagctgaacgtctcggctacaactggacgagcgccccgcatgactcgctttccgacaccctcgcctgccttgccgcacagaaatgcgtcgacgaccataactggtgtgtggagaaccttgagcttaccgaagacgctatcatgcacgccaaaccgattgagaacggttcagaggggcttccaaaagactgctgggacctcaaccccggaggccgcccgtttgccgtcacggagccgattctccatcggctccagagctctgcgaaactctgcgcacgagccggtaccaccacccagttcacgcgcatgaccgtcaaccagtggttcgacaaagcggaacggtcacagcgaagcccgctcggccggtctgtagatatcggacgcgcggcaagtgccttgaacagccagcatgagcatgcggaagttccacaggaccttacaaaataagcaaaggagaaccaacatggacgattataagaaaatcccgttcgatgatccggacctctgtgtgccggatctcgatgatttcgaccagatgaaggaattcttcctcgattgcgcggctgagtattttcgctacctgtcatcagatgatatggaaaagatgctcgctgcgctcgggaaacgcgtcgacgtactcgcgacgccgacagatgatgtatttatctccgtaagcccggacgccgtactgaggcaatatcccgatatcacgatcgacgaagctatccagatccgcgataacgcatgtgaaaacatctgggagtccggtggacagtccgatctcgatgaaatcgtctgggaccaaatcggtgcggaatataaaagtatcaagtccgattcccaccatggactttccgatgaatacgaatcctcgatccagcgcccgaaagcggaaagaacgatcaacgactcgattctctccgtcaaggcaatcagacaatatgggatacagtgttcggaatatctggatttcggttacgatgtcgatgcaagcctgagcggcatgctgtcaccgcacgccgttctggaaccccgacccaacacaccgtatgtattcaggagagccggattcgacaatctgcccttcatctatacgcaaagacatctcaggaatgcaatcgccccaaaagaggctgacaaccatcaacatgggcttaccatcgagcaaatcaaatcgcttccggaaaagctcgaagagccggtagtcgttttcgaccagccgaactatacggtaaacggtaggtcgtttgagggcaaaggcgtcgccgccgtactcgatatgtacgaccctgacggcgtcccggtcatcgcatactttttcccaaacgggtatggaaccaagacgaacgataacggctgcagcaacgtgatagccagcctttacggacgtgacaatttcacttcatatctcgcccgtgctgcaaacgaggaaaagatcctgtatatcgattctgagaaatatgaacaaatggaaaaagagctaccccgctatggtgggacacgattccctccggcgcttgcagctctttcaatggatattataataccttcatcctatatttgcaagatgaaagcggagataaatccgaagctgtccgattgcgaaagggaacataattcccttaaccgcaccatgcatatcaaagtcacggacagtaggcgaaacaggctcgcgcaagatagggataaaccgcgcaacatcactcccaggtacgacgatgacagccacgactcgcagtaagcccactgaataggaggatttaaaatgaacacactcggtctggtaaatgtattgaacaacgatggaaacgtattgatcgatgtggcacagatggccgacagccatatccagaacgccgctatccacaatgcactggctgaatggaacgaaacggacgatccgttctcgcctgaaacgacgcaaaggctgatcggtaaactcaaaggcgagatgccgtcgcttatcgcatggctatcggaagggaactatccaaagagcagcctggtgccggaactgctggcttatgtgaagatgccccatccgctccaggtctataagaacctcgatctggatatcactatcgaagattccgaaaaagagcctgcattcgatgtaaagctctcctatgcgggcaacgcggaacatttcaaatacgctcacctgcccgttgaaacagataagacatccgtcgtattgagcatcatcgacgcgcatgatgacctgcatctgaaaaacgatccggagcatcccggttacagggaagcggtcgaaaagaactattcaaaactcacggacctcatcgggaaagacggaatcgactcgatcagggacttccatgagggcgtagagaccggcaagtatttctcggatatggaatttgacctaaaagacccggatccctccgcgaaatatattctagagtgccttggatccctggagaaacccgttcagaaagcgatggataatttcgcacgggtaaccactttccgcaatctcgcggaaaagaacctcctgcgcgaagcgaccctgtttacctccggtatgctagaggaaaagaacggtcgcctgatcgtcccgcaaggatataggcccggaatgtcgagtgaggaatatcaggcatggcatccatcggcgaggggaaacaccgccatctccgtggatacggcgatctcggcaaagcagctcggaaagctggaagaaatcgccgaatcccagaaacctcagcagatcatcatggatgtccttatcattgacccaggtgaccatctgtctcaaaaatcggatccccgagacccgatggacggggcgtttgtcgatgaaagccacatcgcggtaccgatcagcccggaattcgcgtcaaccgtggcttcggatatgaaaaactcgatcgatgcaaacctggccggcaagcgcacgaaatgcgacatctccaaatggcactcgctcgggaaacaggctcgcgacatgctcgctgagaacagtaaacatgaccgctctctcgctgccgtcagggatgccaagacggccgttgccgacaaggtcaacgaagggcatcaagctagttccgtgcacgataatccgagtcattaaagattaaggctgaacaaatttttgattgaaaggaccttccatgtatcccggtcagcatatgtccatcgaggataacattttctatgcaaagcgaaatatcgttgacagtatttggaaagaagcaaatatcgagggaatcgatatcacgttccctgctacaaaagcggttttcgaaggtgctaaaattgctaacctaacgcaagaccaaacaactgtaattaacaatctaaaacatggatggcaattcatatttgattttattgatgcgcctatcgatttgtcatatgtacggcaggtacatcaactcgttagcaacaatcttgttcccgattctggacaactgcgatattttgatgtgtatattggcggaacaagctggcaaccggaaataccagacttcgacactgcaaaagccgctatcgagaaaattgcgaatatggaacctgggagagaacgcgcgcttaagatgttcggttatctttgtcgctcccaactttttagtgatggaaataagcgaacagcgcaactcatagcaaataaaatgctgattgctgacggctgtggcatcttggcgattccgagagagcaaattaacaattttgagactctgctactcgacttttatgaaacaaacaaaccggataaattcttttcttttttaactaaagaagctatctatggactcgatcgtaccgtaccatcttcacagaacttaaaagtcaagtgtaaagttgccacacttggaagcaacgcgttgaaaacaagaagcaatactgtgggcattagcaagacgcaaaacgctgaccgtacagcgcacaccgagcatattgaatgaatgttatggacatggtataataatattacggaggtaaaaatactatgtctacaatcgctgaggctgaaaaagctgttgaattcaatgtcttctatgcaaaaagaaatgttgtggatagcatctggaaagaggcaatcattgaaggtgtcaatatcacatacccgcaagcaaaagtaatcgttgagtacaaccaaaccgttgaaggattgactgtcaccggaacaattaccgtctacaatcttaaacttgcttggaattatctctttgagcatttaaactcacttgtagattttgagtttgttgccaaaataaattccattttgggtgcatcgcttgttcataacgctggatgtattcgtaacataccagtaggtatcagtgggaccgcctggcaaccggagatgccggatttcgatactgcaaaagccactattgaaaaaattgcgaatatggaacctgggagagaacgggcgcttaagatgttcggttatctttgtcgctcccaactttttagtgatggaaataagcgaacggcacagctcgtagcaaacaagatgttgatcgctgacgggcgcggaatcttggcgattccaccagagtgtaaacatgacttcggtgaaaagctcaagcgcttctatgagacagcggatgattctgaattacagaaatttttaattgagacatcaatctacaattaagagaagcaggaaactgatttcagtcggcttcctgcttctcttttatggttagacgagtttcacttaatcaaagtatatgatataatatactttgaaagcaggtgataagatgcgtactatcgacgctatgaaaaaacttgcccgcaatgatgggcgatttactcatgtttacactaaaaaggagctgtcagaactttttaatgaaaccggcagcaaattgaatggaacattgaagtcgcttattaaagaaaacattttgaatcgtgcataccataatgtatacgtttttcgcttttctcaatacggaggactcggtactttagatttgattggtaagaaaatccgaccaaatgactccttctatgaaagccttgagtcctctgcttcagcatggagtctcatttcacagatccccacggtcgtaacctatatgaccacaggaaagtcaaaatggtataacacgggttacggaagcatcgatttcgttcattacagcaaaacagatgagaaaccaagaaccatcgataggtcgtcgatgggaagggttccacttgctgataaacttcaaacatatcgagacttacaaaaaaccaaacgttcccttgatcttttaagagaacaatacgacaaagaccatggctgccgcgacggtaatattcaatattatccatgcgaagatgatgacacatgggatttcctagataatttggaggaagatatactttaaagtatatcttcctatttttttggagtccctatgcctttatttgcatcgcttactcttgttaaagaaactgctttaaaagaggctgcttctctaaaatctccgttactgacttcgtttatcgaaaattacgtcaggcgtcaaaagctctttctaacgaacgaacagatcggcaaatagattcctttgacaaaactgagcattaaaacgttatcgtcttgagagtcttttagaaaggaaagcaataatggaattgattcttgccgagaagcctagcgctgcacgaaattttgcaaaggcgcttggtggtaaaaccggcagctatgccggaactgaatataagattacgaacttgcgcggacacgtcatgggactgttgcccccggataggcaggttccggccgataaggcagatttctataagagctgggagcttgagaatcttccatgggatctcgatgatttcgcatggaagaaggggatcctaagcggatgcaaggacatcatctccggattgaaagacgagctgaaaggtgccgattgcgtcgtaatcgcaacggatgtcgacccgtctggagagggcgaactgctcgcctgggaggctctggagaaatgcggttggaatggccagaccaagcgtatgtactttgccgacgaggcgccggcaagcgtgcagaaggctttcagggaacgcaagacccttccatctatggacaaggacggtgactatgtgaaggcggtcgtccgcgagcgctgggatctcgcgagcatgcagttcacccgtgcggcaacactcgtagcgcgaaaaaaggggttccgaacggtcgtacgccagggccggttgaaatcggtcatggtcaaactgaccggcgaccagttgaaagcctataacgaatatgtccgcaagccgttttacgaggcgcgtttcaaagacgaaaacggcaacatctttgccagaaagaccgacgaccccgaagatatccggttcgatagccccgatcaggtagacctttcgcagttgcacgatagcgctgtcgtagaggattccagggcgaagaaacacactgcccccggaaaactcctcgacctcgccggcctgtccgctatcctcgcgaagcaggggttcaagccggcaaatgtcctgaagacatatcaggagatgtatgaaaaccagatcgtaagctacccgcgtaccgaggataaggaggtcacgccggaacaatttggcgaattgcttccgcttgtcgataagattgccagcgtggtcggtgtggatacgtctctgctctcccatcgcgccgcaaggaagacacatgtcaaggaaggcggggcgcacggcgcgaacagaccgggaatcaatgttcccgaatcccttgccgagcttgaaaatggttacggaaaaatcggttccgcgatctattccgtacttgccaagaactatctagcgatgctcgctgaagattatgaatatgagctgatcaaaggccatgtaagggactttcccgaatatgccgggcagacccagatcccaatcaaaccagggttcaaagcgattttcgattcggactcctcttctaccgagaaatcggaaggggaggaggcggagaacgcctgcgagttcggtaaggtcgcctccccgtatgtgcacgaaggagccaacaaacgcccgcaaaaaccgacaatgaaatggcttacgaagaagctcgagaaatataacgtcggtaccggcgccaccagaaccagcacgcttgcggaaatcaccgccaatgaggaacgcgccctcatgaaggaaaacaagggcgcactcaccatgacgaagtgcggcgaggtgtcttacgccttgctgtcaaattgccagatcgcctcaccggaagtcaccgagaagctgttcgaatccatgaacgaggtgggacggttttcacgcaaaccgtccgatgtcatcaataccgtcaccgatatggtcgtgcacgatatgaaggcaatgcaggataacatcggtgcattggacggtatgaaactaggcgacggaaacgcgatcgtcatcggcaagtgcccgaaatgcggcaaggacctctatgcgacgaaaaatcagttccgctgcgccggagtgcatttcaagaagacaggcgagaaagatgggaaagccgtcttcgcccaggacggaacctgcgacttttccatctaccgttttgtcggaccaaaggataagccgaagaagctcaccgacaagaacggcagggagatcgccgaaaaaggaaagacatcgctcatcaagggaatcaagaagaaaagcggggatggaacctatgacgcgtatctcacgctgaatcgcgagacatggtcgcttgatatgcaattccccgagttcaagggaaagaaacacaaaggctagttcgggactcccaactttaaacaatgccgcttctgacaggaccaatttcggttattcggatagcgtcaacggaatcgtaaccggtaacccgtggaactttgactaatgcgacagccgatggtttccgcgatcggtttgatacaattgaccacaatgcagtcagtaaatgatgtccaagctgaagccggagatcgatagaaaggaatttcattatggaagaaaagaccgaagccgttaagggcgaggaaactacggttggtttgactatgaactataacccgttttcgttcatttcctgccaggaggacgccttggtgctggcggggtgcatctcacatggcttggatgcagatgtcatcaagaaaagcggggaccttttcgcgaccgcccgcgccatgcttctcgatgcgtgtgtctgcctgctctatcgccagggcggcgatgcgatgagcatgcagggtctcgtagatcttctgcagaacgacatcagccataacgaggatcaggatatgccctcgatcaaggctgcctatgacaagatcgaggccgacggcgcgactgtcgaggaggacctggggctgaagcggtaccgcatgttccaggccatcgcctacggtgagacggcaatctccgtcgagctggacctatacgccaagttgtccgctatggtcgataggccgcttgtcggctagacctgcaagccgaatcgatatgccagcgattcgcatggcgatgcgctattcatgcggtgcctgacggcacctatgatccgctcgccagggctcgctgattgatttttctggcactcttctctttggggcatccggctatgggtgccccttttttgatgagagatggtagaatcttacaaagaaaaataaagaaatgggggatttaaccgtgatcggtgacaacttaagccaagcaaacaaagtaaagggcacttcctgcctttcgggtgatgtgcgatgatgaatcgaagcggaatcgaaacgtatgagctgttgcgcctggatgaggtggcgctcgccgggtatttcgatttggaagataccaggtttgaagaatggtatgaaaagaaccgcgcagtcggcgacagattgtacagcgcaattcttgatagaaaaattgacctcgtagctttccgcggaacggaagacggtcgctactactccatccttacgcgtagcccgaaacaggaaggctccctgcagctcacggatatcgacagcaagggaccgatcgggcatcgccggcttaccgagaccgtcgtaaagcccctggatttatctatggggatataagacggtagatattatgcagctcaatactgtataatatctataccatgaagtacaagagtaaccgcaacatagttttctcctgcagctaccacgtggtcttctgcccgaagtaccgtcggcccgtcctcgtggacggagtcgacgagcgcttcaaggagatcgcgtgggaagtcgccgacgagctcgggttcgagatcgccgagatggaggtcatgcccgaccacgtccacctactcctgtcaatcgatccccagctgagcatccaccgggcgatcaagcgcatcaaggggaggtcaagccacgacctacgcgaggagttcccgtggctcaaaagccgtataccgacgctctggacgaacagctacttcgtgtcgaccgtgggaggtgcaccgctcgcgcaggtgaggaaatacatagagagacagaaggaggtctagccgatggaacgcggattcaaataccgaatctacccgaatgagtcacagcgcgaccagatcgcgcggacgctcggttgctgccgcttcgtgtacaaccgcgccctcgacgtcaagaagtccgcttatgcgaagactggcaagacggtctcgtggacggcgctctcccgaatgctcccgatatggaaacgcgaccacgagacctcctggctcgcgcaagtggactccatggcgctccagcagtccatccgcgacctcgaccgcgcctacaagaacttcttccgacgcgtgcgcgagggcgggaagccgggcttccctaagttcaagtcgcgccggcacgcccgacagtcgtaccgcaccaacggcggcaaggtcctcgaccgcaaccatatcgcgctgccgaagctcgggactgtccgggctaaggtatcccgaccgctccaggggcgtttcatgtcggtcacggtctccctggacgcggccggccgttatttcgccaccttcctctgcaccgacgtgccaaccaaggacatgcccgcgactgaccggaaggtcggaatcgacctcggcgtcaaaacgctcgcgactttctcggacggcacgaagatcggaaacccgcgccacctcaagaaatatgagcgcaagcttgcgcgggagcagcgtaggctctcccgcaggaagggcgcacgcaggggcgagaagcagtcgatgcggtacctgaagcagaggaaaagggtcgcccgggtccacgcgaagatcaccgatgccagaaccgatgcccttcacaaggtcacgaccatgctcgcggacgagaaccaagtcctgtgcatggaggacctgaatgccaagggcatggtgcgaaaccgtcgtctggcgaaagccgtgacggacgcctcgttcggcgagttcgcacggctgcttgagtacaagtgcgccgagcgtgggcgctcccttgtcaagatcggccgcttctacccgtcgagcaagacctgctcggcctgcgggcacaggctcgacgccctgccgctgtcggtacggtcatgggactgccccgcgtgcggtgcgcaccacgaccgcgacgtcaatgcggcgagaaacatactgacggaggggaaacgcatcctctccaacacggaaggtaccgcggggcacgcgggaaccgtggcggctgtagccgcctaaacgctcggggagaggacgtaagaccctagaggactatatcggtcctcgacggcagacctcgcagaactgagaatcccctggtttcaactacggggagtgtcaacgaactcatccttgtcgtaagcaccatcgtatccccagctgtaaaatgggatgtcgtcggcctgttcgatgagattcataagcccaacaagactttcaggagtgtcattcgcctgaatccatgcgcccaccttctccagatcggccgggtttgccgtgacgagctgcttcgcaagcaggttcaagtcctcgagatggcaaaactcgttaaagagcagcctcgtgccgaagggaatgccatcataatcagagatatagatttcctcatgctgtgaatcctgcagttggttgagatggagaaagtcccgaatctcagcttccgtcttcggcaaggtgatccatgcatcgtgaaggctaccctcgttgtagtaaccgtagtttccgatgcatacgttcaggccttttgtgaagtcctgtcccatggttgccctttctactctataaaccgtagggttgcttttgtaagattctaccacttcaccccatctctatttcggtaggattgatatccacccataccgacaaagaagggaaccgatgagaaaggaaaataagaaatgatttcgcgacatctgctcattgaattatgagacgaagtcggtataatagcccaagagaaacaccaaaaggaaagtgcgtgtttatgaatgaaaccatgaagccctcttgtggggaggcatatgacgcgatgcctgtcgccgtcctcgctgcgagcgaaaccctcactatcgcactcggcatgctcacaaagtcacctgtcgcggcaatcgtcgcaggcggcttgacgggctgcgtgtgcagcctcgccctcccagccatcagcgggcgcatcctgggccgcaagcgcgatgcgatcctttcctggtgggatgagaaccttgaagtctacaagaagttcaaggtggagaatccagaccgcgaaccgagcaaacgcgccgagaaacgcgaggaacgggaccttgcgatttggtggctcgatgccatgaggctcgtccgcaccaaggaactcatgcgtgagaaagtcgaggcgcttatcgagacgggtagccgcatgccagatggcgtgaatctcgatgattatgagaccgtcgaggagtaccgtgcccgctacgtcgcaccggtctccaagatgacctccgccatgctttcccttgccgtcggtctcggtaccgccgcgacctgctatgtcgggatgaccggcaacctccactccccgctgctgtttcttctcggcgggattacctcgattctcgtcacggcagtcggcgcgatgtgcgaccagcgctcacgcgttctgcccttcggcctgtctatcgccacataccctctcgccgtacttacggcgttcgggcacggcggtgtaagcggattgatcggcaacctgctgtgcggtgtgggtatctatgcgattttcgccatcaccaaccatctcttccgcatcaccggcggcgccgatgcagtcggtgccggcgatcgcaggctcgtcccggcgatcgcgacggcatgcgggttccacggcacggtatacggcatgggcgcgatgtgcatcgccatgctcgccaactacatcccccgctaccgtgcgaaagagatcacccttaaaagccgcgtacccatggggcctttcctgctcgtctggctttgcaccggcgtgccccttgggtgtatcatgtagcagtctatcccgctgtcccccgcagagaagttaggagtagccgatctgcgaggaacaactgagaatagagtctttgcaaccgtccgaatggacacaaaggaaggagaattcccatgaactctatccgcaatcgcgtctatgccggtgagatcgccggcggcgccgacaccgtcgagtacgtcatcgttgccattgtcgccgtcatcatcggcgctgctctgatcgccttcggcaaccagatgcagaagcagatgaccaagactggcaactccatctcctcctggttcgagtctgcccgcaacgctgccaataactcgatcaacggcgttggcaagtagtcaacctcctttctctctgatagcataataccatactactaaggtatttgtttcgagaatcgagaaatgtgcaaccaaggaggaactggacgtgaaagacatcttcaagaaaccggagtccgaatcgggcgccgcaatcatcgaatttgcgctcggtgtcccgttcctcctgatttttgccatggctgccatggaattcggccagatttcggcggcgacaaccgctgtcgacaacgctgcccatgcagccgcccgagagctcgccgtaaaccccagcggcgatgcctcatcagctaaggaggcggccgtaaatgccgcctcctcttttttcgctgaaaacatgaagatcgagacagatgtctcggatgccgagagggaagcgtacacgcaccggattcccgattcaaacggatcgtcctatacggacagggagtcgaatgtctccacccggaaatgcaccgcgaccgtatccgtgaccatccagccacagaccgtcctcggcgatgcgatctatgccgccggagggttcggaggcggcatgacgatcgaatccaacgccgtggagttaaaggatgcaacggtggaaggaggtgcgtcctcgtggtaaggacccattctgaaagaggctcggaagtcctcgaggccgccatcgtcctccccatgctcatcgtcctcgcattctgtcttatccaagtttgcctgatagcatatgagggcaccgcgatgagcgccgcaatcgagtcggccgcgatgaagtccgatttctccgccgcaatcgcatccggaaatgtaaaccaggcggtaaaggacgaactcgcatcgaacacgccgggtatcgtcaaggacaacatcaccgtgacgaactccaaggtctcctattcggacaggtccgatgagggcaccgtcaccgataccggttccacgggaatcacgaccatctcgaaatcaagcaccacggcgcttctcgaatcgaccgtcgactataaaatcccgaccctgatttcggtcggcagcttcgacggtatcaagatgtcgaaaacgatcaaagtggaggtcccggtttccgagaaaatggaggtgtcgcgatgacgcgcgtccgcagcgaatccggcgcaatcaacatcctgaacgtcatcatcatgctcgtactcctcattgcactcggcttcgcattcgagctctccgcaaccctcgaccagcagaacgcccagacaaatgactgctccgcagccagggacgccaccatggcgtcgcagaacctccttgtcgcgaagaactccgatgaccccggtctcgcaatcgcgaccgcggccgtcaagtccctgcgtgccaacgggttcaacggcgaagtcgaggtctggttctatgaagccccctcctcggccgtcccccagagcaaacgcgcgtgggcctggggcatccagacgaaatcgtccttgaaaggatactttgcgacctattcgctcggagatttcaatatccccatcggatcgcacgtcacggcacatgccgtcccctacactgcgggaaaggcatggagaccggcggattcgggtaacggaaagtattccttcaaagccggttcggacactcctgaatacgaggagtacacgtctacgaaagagcttccgcaagaagtgatcgacgagatgaaaacagccgtcaaccaggcaacgaacaataaatagccttcccaatgagctaaaatgaaaggatatcaggcgacatcatgtgccaatgcctgatatccttttgctatgccgcgtgtctgacggcatctctacacaggaaagcgagaaaggaacaccatgccagacaccaacgataccgatgcgatcctcgcgaaagtccgttcaggcgagctttcggcaggcgatgcagccgccctgatcgcgaatctccacgccgcatcctacaaggcgatgcaggacgcgcagactgcacaggctccgcagcccgagtctcccgcacctcaagccgccagccagccgggcatgtcccagcaggcaccggtcgcggctgccgcaccttgctatcagccgcaggttccggctatgccggcatatgccgcaccgacgcccgatgcggttgccgagaaggcgcaagagacggttccgcagcaccctcagacacctacagtgcagcgccccgccccctatgagccgcctgcatatgtcccggctgcatcggcatccgagccgcatccggtctacgaccagccttcccctgccgtgaatccgtatcgccagccggcacccgacacgactgccacgcttccggcgcaggatgccaccgcatcccagccagaaccggaaaccgcgtaccatcaggcctcgccccttccgtataatcccccacaggagaccgacaagtacattcccgtcaacgagatggagtcctccagcttctttaccgattctgaacctactgaggaacaggagccgaaaaagaagcgcgagaagcctgcaaagccatcgaagccgtcccgtgccgaacgcaaggccgagaagaaggccaaagaagaagccaaggcagcgaaagcccaaaagaaggcagccggccgccgcggcgccacgtcccccaatgctccgagcctcacgggcatggagaagatcgccgtgaaggtctcccgcctgcagaaggtcaccgccggtctcgctgtcatcgccgtcctcgcgggaggtgtcgccgtcgtatcggagatcgacgccaacaatcgaatcgcagaagcgttctccggcaccaccgaagtcgtcgcagccacgaagaccatccacgccggcgacgagatctccgcaagcgaccttgccttcgtctccgtcccgaacagcacggtggcggacggcgcaatcaccaagaaggatatcgacgactcctccaagactcccgtcggtcgcgtcgcaacccagtacatcgccaagggctcccagctcaccaatgcatcgactgccggtaaggacaaccctgagtcccttgccgccgcgatcggggacggcatggaggccgtgaccatctccgtcgatgcccagtccggcatgggcggcatgctccgtgtaaacgacagggtcaaggtcatccagcccaacgacggctccctcggcggcgatgggttcaccgtcatcgccgactccgtacgcatcgcagccctcgacggcaacttcagctccggtagcggctcctccgacggatatagcaccgtgacgctcgaagtcacgcccgagcaggcaggtaagatccgtaccgccggtggccttacccttaccctgccctcttctgccgataccaccgagagcggtgagtagcccatggcagacgaaaccattttcaggatcaaggagcgcatccgccaggagatgcgcgacctgctcggcgtgaccatggccgacggcggcgcgatcgaccgtcaggcgcttccggcccagatcgacagtgtcgcccatgaagtgtgcgccgatttcggtatcttcgacgaaaactggatcggctacatcatcaaaagcaccattgacgatttcatcggtctgggtcccctgcagcccttgcaggacgatcccaaggttgccgagatcttcatcgatcccgtcggcgtcgagccgaatggaacatttatcacgccggtcgcccgcgccgaagtggacggccagatcgtcgattgccccggtatcgacctcgtctcgcatgatgaggtcggtcggcttatcggacgtatcgccgaggaggcgaaccgccgctgcgacgattcgtttcccgagatggacgccacccttgccgacggctcccgtgtgcacgcagcccacccgaaggtctcccccaacggctggtcgctcaatatccgtaaattcagcaaggacaagctaaccgctgaggacctgctggagcgcggtgccatgagcgagcctatgtacatgttcctcaaatcggccgtccaggcccgtgcgaacttcatcatctccggcggcaccggttccggtaagaccacgatgctgaacgcactctccgccttcatcggctataacgagcgcgtcgtgaccatcgaggatacgcgagaactgcagctgaagcagcgcatcgtgatcccccgcgtcgcctgcccaccgaactcagagggcaagggcgagtttacgatgcatgagctcctggtcggcgcactccgtgagcgtccagaccgtatcgtcgtcggcgagtgccgtgacgatgagacttacgagatgcttcaggccatgcagacgggtcacgacggatcgctcacgacgatccatgcgaacgactgcgccggtgcattcacgcgtatcgagaacatgatcctgaagagccagggcaacatgaccatggaggcgatccgccgccagatcggtgccgcgatcgacgtcgtcgtgcaggtgaagcgctggaggggcggctaccgccgtatcgagtccatcacagccgtcgagggcttttccgacggtaacgtgacccgcaacgaactgttccactgggagggctcgccggaaaacggtaggcatgtcgcttctggataccaaccggcgcgtctaaaggaaaagatcctcgacgcggacgcggagtacgacccccgttggttcgaaggcggtgtctggtaatggaacctgccgtcatcatcatgatgctgagcgttttcttcctattgctttccatcaccgtcggcctctattccctgttctgcgggttgtcggctgccggcgatgtacgccgcatgaggaattcgactgcccttagaaccggcgagtcggacgataaggacaaaaaagtctccacgccccttccacgccttgcggaagccggtattgaagtcgacggcacgatatggatcatcctcctcgtcttgctcgcgggagcgggtgccctcatcggattcatggccctgggacttatcggaatcggttttgccctcatcggacccctgattgccgagctgtgggtgcgttcccgcggaaagagccgtaaagcacgattcgatgagcagttggcgcggtcgcttcccatggtcgcggaaaacatgcgtgccggatcctcgattgaaagagccctgcgctctgtcggggagaattcagacgaccctctgaaatccgagctcctggcctgtgccggcgcaatgcagatcgatggcgatatcgtcgccgcgctcgatgacatggcgaaacgaaccggcagcaaggaccttgtcctcctgcaggccgccgtggcctcgcacaaggaagtcggtggatcgctggccgactcgctcgagcgcatcggagacaccatcgacgcccggttgtcgctccgtcgacatatcgagtcggagacgtcatccgtgatcgcatccatgaaggcacttatcgtgatgctgctcatcctgttcgcaatcatcatggtcggcatccctcaggcatatgatttctatacgcaggacccgctcggcattcccgtgctgatcgtcgtggtgctatttgcggcaacgggctccgtcatcatctacaaaatggcagacatcgacgtggaataggagccaatcgaaatgaatatccaatatctcctcgtgctcctgttcgcctgtgctgccggcggtatgacttatgttctcgccggcgagcccttccgcaagccgctggcgcgcgccaggatgtccatcgccgcccgtaaggggatgcacgccaaaccgacgcagcgcatgaagatcgccgaggcaatcgaccgcgccggagaggcgttcgaaaaggtcatcccgctcaagctgtcggaatcccgagagctgcagaacaagctcgacctggcagggttaaagatcattccttcgacctggcgtgccatctctctcgggatcacaatcttcaccgccatcatgcttgccggtgccgcccttgtgggcggatatggaatctcgatggcactcctagtcggaatcatcggcgccgtcggcggatgggcggtctgcggaatctggctgtcgcatgcgggaaagaaacgcggcgaagagatcgatcgctatctgccgccggcactggaactgctcactatctccgtgtcagccggcgtgctcgtggagcgtggattcaggcagcttgccgagaacaaggccctcggtccgctggcagacgagttcgcgcgtaccgatatggagatctcgcacctcggcgtgtcccgcgtagatgccctggaccatatgcgccgccgatgcgattcaccgctcatgggatatttctgcgcggcgttaatcgaggcgaccagaaagggcacctcgatctcaggcgtcctcgaatcacaggcaaagcttgcacgcaaggcgcgttacgatgcgctgaccgcgcagatcaacaagctctcgacgaagatggctgtcccgctggtcttcttcctgattgccgtgctcgtcctcatccttcccccgctcatcattccgaccgcaagcatgctcatggaaatcatgtaaccgggagcatcagcttaatgacatgaagcagccggggtgcagatttgcgccccgactgctctccttttcccaccataatcccggacataccggtaactttttacagtctgccgcgctataattttcgataactataaatgttcaagtaggttaggaaatttcatgctagataagattaaaaacggggtgaaagacatccctatctcagcggacgcttttgggtttgcagcggtcatggcgagcgtggcgcccgtgccggacgctataggcaatttggtaacttctatcaggtacattgcactttcgcattctgtctggtctgtcctgcaaccggcaattccagtaatcattcttgccctcgcagccattgcgttttgcaaaaataactataaggttgcacttgcggccggtatcgtcgcaactatctattttttactgccggcttcccatatgagcactgagccagttgtaatccagctctgcgataccatctgccttgccctctacacattaaaattgtgcgttcaagataactacgaagaaaccggttatgccgaatagggagctgaacgatccaatggaaaaaagtaacgagatcacccatgtcaatgcggaactcatcccacaggataattcggctgaaagtgatgatagggcactctcccgccgccgtgtactcgaagccggcgcagcggcgttggtattgctcatgatgcccaagttagcgttcggagcaacctgtccgggcggaaatcctccgaacgaaagaggttggttcggttcaggaaatggatctgttgtccatcatggtgggaactatatcggtgttgcatctaagacctggtggtggcaggtcggatatagttgggatgcaagccaatggctttgcctctccttcagggtatacgtcgaatcgattttcacggatgagctctacgatatttttaaggttcacgtccaggcaaaatgcggcgatgtaaacacttcaaccggtcatcgaatctggttttccaaatataaagataactatcttcatttttgggtgagcaatcttggaatcgccggcagttcccaaaaaactgactgggaagataataaatacctcgctttctcaaacgaaaacctcggtggcggaaatcgaagttggtggagcattactggttggtccgattcgggatacgactccccgacatacctctataagcggaacaatggtcttcaagacgcctatttcggccttggagtttatgtttataacgtcatgtgcggaggcgtcaataactggaccacacctgacagagtttttcttaatggatttacaaattcccctgataccttcatgggcagtgatatccacgcaaaaatcgataaaattaccctcgaccaggacatgtccctgttcggcaagatcgtcgcaatcgttccggattccgtcaaaagcggatatcaatgtctggatgtcgatgccgcaggacagtcctccggcacgctcgttcatctttacggcgcggacggaagtggaacgaattatacgcagcgcaatttcatcatgggcctcggcgcgatggacgaacgaggcggtatcacattcaccatcttcccggcccatgtgaaaggtttcagtcgtgtgctcaatgcgtcgggaggaagaagctatctagagcaagccgcacaaaaccgcaccgcgccttcttccactcaaacgctccaactctacggggatgacaataccatcgccggtcgattctgggtcacaaagagtgtcgacaagaacggccgatacaacatcatcagcgatgcgtccggttttgccttcgaccaagccgacggcaagaccgccgaaggaaccattgtccggctgcattccgacggtattctcggctccgaatggtcgaatgaagcccacaaatggcgtatcgaggaagtgttcttcaagggcacgatctcgctcgatgccgagcgcgtcgagcccggtaagacgatctctgtcatcgacccgtcaaagacgtgcacgccctacgatatggctggcaccggttcggtgaaatacctgtaccgctggtactggatgaaagacgagagggaaagcccgtttgccgaaaacaagtatcctgaagcctttacgttaagcagctggtgccatcttgcaaattgtggcgatcagatctggcgtgacgcctatgctggcgcgggataccccgttcgcgacactaatttcttcgttgagtccttcaagctgaggatcaagtacggtagcggtttcatcgagaacaacgccgactttggagcaatctgctacgccggatgcatgggcatcgaaaattcaggcgatttctcttggtccgacgtctgccgcgacggcgaggagcttggcaagggcggtgtcagaaaccgcattaccggtatcaagatctggcttgagggagatatcgccaaggaatacgatatcgcctatcgcgccttcatctatgggcagggctggacggaacgtttccattccaacggcggttctcaggatgatgcggagctgtgcggttcggatgatgcatccggcagcaagggagccatcaagtgtatccaggtattcgccatcccgaagccgcgcggtgccaagctggcacgagagttcgccgaagacaattcgtttatcccggaaaactcccattcgggtggctatctcacggcacaggcgatgctcgcgctcaacctcgatgacacgtcggggttcgatgggcacaagatgatcgccgatgcgtatcagggcgacagctcgaagggactggaggcactgcccgtaccgccgactcctccgcctcctgtcggtatcaaagtgttctattatgtcgacggtgaaaccgatccttgtttcgaggaagagtacgagatgggaacgacctatcaggtgaatcccgatgcgactgccgccggtcagaaggacaactgcctcaatctggtctgctggtacacggacccggagtgcacgcagccctatgagccgcgggcactcgatacctcgttgaagctgtacggttacaacccttgctcggtaaaatacgatacgaccacccgcagcagcgtgctggacacctcgtataactggtcgacggacgcggaccttggcaccgcgctcgacctggcgaccctgtacccgcaggacgaggtcgttaagtatgggacgaagctgacgtttgccggtccgtggtccgcttggtgcgaggatgccgggaagacgcgctgcgtgtccagcacgcccggtgtatacgccaacgcggccgccagcggatccccgatcctctcggcgaccatcaagggcaacacgacggtttacgtcgattggccttggagcggctacgacggcgtcatgagcgcacggttgtagtggagatcgactgaaggaactgaaagaggggcaagcggaaattccgtctgcccctcttttttgttgtgaatgtttaaacttgccgctttatggcaaagaaaagggcgagacctagagcgtttggtcgggatccagttccccgaatactactctaagctcgccactaatactattatacaaaaccatctttgtatttgcaaccgcggaaacaagccagtctcctctgccgccaatccatcgcttgaacaaagaaaagaatacatgcgccctattcaagaaatgaaaagcctcatctttcattgcaaatgaaagatgaatccacccgttaaaattcgcaagcgcttgcgaataaaaaaagaagaaggctgcggagagagaccgcaatcttcttctttttcctgtataaaaataggctgatgccggtagataggaataccggccaacaaggtgattcccgaaggaatctttgaaaaacaatattactatagcatagtataggtagtttgtctactttctctgccgcgtcggcaagacatcgtcgggatcgatctcatagagcccgaatgccgccgcgatcttcatcatgtcacgcataccggcaagataagccgtatcgacctggttgcaggcatggacgcggacagcgcggataaagcgatccgtcacatcccgaagctcctgcggaatctcatgagagatcttgagccaatcctgctccgcaaaatgctcttccatctcactttgtcggaaaccgggatcacgctcgctcaactcgaccatcgatccgtccttcagctcagacagggccgagcgcaaagcgacctgaaagctattttcctccatacgtatcctccttccgttaatgcgatatgctagtattatagcactatagcagccgaaaagcaaccgtatgttcgagtgttcgcggtatatcgcacctttcaaaaccgatgaaggcaatagcccgatttattcgacacgagcccgtaaatgctcttcggaaaatactcttcaactgggactgattcccttgccgcatcgaagagaccggatttcaaggcatgaattatccgctcttccgcaactaatgccatgagctcgcagttactcaatgcgaagaatgcgattttttccgtgccgagtaatttggcggcactctcccataccgatgacaagagcagcgccgaggcgcctcccactcccccgcttagcctaccgatctccaacatagcgagctgctccgttgtgccggtgaagccgatccgtatatccgatttgaggttgcgggatgcatattcgaacagcttccctctcggcaagccgaatgtatcgagattgtcatacgtcacgattgcggctgcgtagccgtccgtttcggattcaccctcgacgacgtaggtgacaagcagatcgagatagcgatcgtagatgatccccagctcgtcatagccgtcagccttccaggccggcgacagcaccggatagatcctgtacggtatgacttctttagcggggaccttatatatgccgtattccatatcaagatcgcatatcggctgccccacatcgaacacatcaaccatttcatttcccatccgatctcctatcggatggaagcggcgataaccaccgcgccacatccttcccatattcaattcctcctgtaatgctttgtgtaatagtactataacatcaaaaaagcgtattgatacagccgactacatttacgatggctttcgatccatttcgatgaaatccttcccgacacttcctatagtcgcttgaaacagggaggcacggcgaacgctaaaaaaggggcaaaaagcccctttcattaccgttctctttcagttcttgaaactgagtcattcatccgcggtgtctgcaaaaccttatcacgcttgacacgcaatggctccttttgcccgactgccaacttttcaatatgccgttgaacaccgccgatgtttcgctcgatgcgactttcgataacgtcaagtcgagcctggataccatcattcccatgggacaagatctcctttgcctcaagagggaaaccgacaagcttgcccctatcgaaccagctgtaatctctgaaaaggctgagctgcttgtccggagccatacctttcggtccaaacggtttcgcgatatagctatcttccgcgagaatgttgtaggcgtgacaccaaaggcttgtcccattatcgaaaatcggcgcaaaccttgtaaattcaagtgtttcaacatttcggattaccccgaagttacgccagtgccggtcttgattggcaaggatgtaatcacaggtgaacatttttgccagaccttcctctacattgttgagaccaaggctcttgtaggtgtccaccagaaagtcatagtcactcatagaatcaggtttctttcgtgttgaaagtacgtcatatgcggtgactagctcctcatcctgtccgagcatgttctcacatgcggaatagattcgtcccttctcctcaaataggaagtaggggatgtaatcgtttctgcttagcaggcggtcatatagcgccgtcgccacaacttcgttcagaacctcctgccgtgtcgacccagtcccgcctttcacgaggaatcgcttgccattgacgatcttccattttttattgagatcgccaccaagcgtcgagttcggcgacatcaggttcggattgccggacgattcctgtccaagagtcaacattccaagatcgtctgtaaagtcattgtcgaagaaattgacatcctcccatttcaaaggattcttactgtcgttgatccagtaacgatcagatagtgaaagtccaaaattctcctccgccagttccaacgtgctattgagattcaaagaatcgagaagttgctgaatctgatgtcgggacgccggaatcgcacgccgccgccaccagtcgttgagcgcacgcctggtcacgataccttttgaatcagcgagagccacgggtgcatatctgagatcatgaacatcaacaaccttcaccactgcgtgaatatcgcggtcatatctgaaggaaacaacggggtggttcttgttcatcaatgtgtattcagccattttcatgatttcccctttcgatatactaatacaataataccattaccggcacgacgattcaatctcgagcactcgacttgattcgagacattcgagcagcgcgaatcagatgccacccgaatgccccgaaggggctccgcccctttatcgagggcggatacctgaaaggcggtactcgccgtctgcgaggcgcatcggatagatactgtccgtgaggcgttcctccggcgcgacttccgtctcattgatttcatggaccattgcgagaagcatttccggttcaccggctgtctgcggtacagcaatgacttctgaaatgctcgatggaaggaagacgaggctgtcggtcccgaacatcttggcaagtctcctgcgaaccgacgggagcaacatcgccgcggccccaccgaactgcttatctttcctggccaccgcaatcatcttgaagccggacgcgtcatcacgcagcgtcatgaaatcgacaattccttcaaggtttgcaaaagcagcctttcggattttctgacgggaaattccgaaagtctcaagatggctgtcctgaagtcgaatcgttccgattccatcattcatctgcatcagttcgacgcgatatgtaatcagcatgtcgagatatcgatcgaatgtgataccggccttcgcaaagctttccatattgttttcggatacgacaactggatagattttctcaaacagctcgccgctcttgaaaaaggcgttcagcctctccccgatcgtctcctggtcttccgtcacacagtatcttccatcgagatcgtttagggtatcgaaaagctcctcgtccggcatctgcgcccagcgctcgttctggtaaacgtttacagacacccttgttccggcatccaaggtgtacccacgctcgataccattgtttagcgtcttctcagcgtagcgaagcctgaatttggcatccctctgttccgcgatatgattcagtgccggcaatctcatctccagttcctccctggtcatcattctctgtccattcatttctcttctttcttccatttggttttcctccttgtttttcaacctactgttttctttggtgctcttgtaggttcggcactcaacatccgctcttccgtcggcgcttccgaaccctgttcagttttcaatgtgctggcgatttcccgtcgccggtatccgttcaagaccacgatgggactgaaacgacaagggacaagtgaaacgatgcgccgtagggcagcccttgcgtttccggacctcggtgggctaggaaacccgcgagcgacggggaccgctcacatggaactaacagtgatcggttgcaaagatgggcagatatcgcggctttgacgaaatccgcaagcgtttgccaaaatacggttcagcaaaaacatggagagaaacgtgatggtcggatgagaatgagtggtagaatcttacaaaacagggaaggaggcaagtgtttgagggaaatcatcgtcgacagggaaaatggagccaaggcattcgtcctattcgaactcaccaaaggcaacatcgcggaaatcaaagaccgatacattctggagcaactgcgttccgcaatcgatagtccatggagcactgcccttcccgacggtattcgctcagctctgatacgttcggtttcagaagagatggaagacagattccttctcgagaacatggacaaagataccgatatgagcgtcaagagcgctatcaggagtgccgcgataaaggtcaaagaccagcatggggtcaaaaacggaccttggaccgatgcatacggcgatgccgatgtcctcgattatgcctaccaggagattttcacgcgattcagtgatggtccgggcgtcctgctcgatgaaatcgaaatccccgaaggataccgaattatttcaggtgagaaatgggcaagcgacctttcgggaatcggccgggaatggatcgacgacatcaagcccttcctcctgctggcggataagaccggagagctcatgatctgcgacatcctgtcgaagcggaccgtgccagtcgttgccgtcagaagcgatttcgcagaacggtttgacaagcttgccgacgaagacggcatgatcggcgataagttctggacatatgcctgcatcgcagaggccaggggccgcaatatgactttcgatttccgcggtgcagtatcgagggcattcgaattgaaggggcgagtcgaaaaaagcgattcgccagggcgagacgatggaaagttgaccgtgaagggcgagatcgcgcgagcgggtgccgataaactcgccgaagaggccaaaaagaagggagagttgttgcttgacgggtgatgcaagagagagcgattcgacttgcaggacggatggcaactcgaatgggcgatgcgtaccgcgacccgcattccatgcggtgcctgacggcacctatgatccgctcgccaaagctcgctcgatggatagattttcaggatcaaaacgactagaaggagacgacaaatgacaatgactaaattctcccgcatcaacaagcagcgcgaagaaatcaccatgcgtgttctggaggacatggagaaaggcggtaacgagtggaagaaaccgtgggtagaggcctcccctttcccaccgcataacccggtctccggtacccaatacagcggacgcaacttcctctacacatatgtctacggcatgatgcgaggatatgccgacccgcgttgggctaccgagaagcagatcaaggaaatgggctggaaaatcccagagaacctgcagaacggacgcggtggcatcaatgacgatctcggcgtaggcatcgagcactggggcatgtacgcctacattccgcgcgtcaagaaagacggaacgccgcttaccgacaaagggggcacgcagaagttcaccagggttcgcgccgtcaaagagaacggcgtctggggacgctaccgtaaaggcgataacggaaaatatgaattcgagcagctgccgagtggcgtccatccgcaccccgaatgcgaccgctacttcaaggtattcaacctctcacttatcgagggcgtcccgccgcttcccgttcccgacctcgcgccgaatgacgatatcgaagtcgggctccttgccgatgacgtgatcgcgtcgagtaggtgcgaggtgttcgaggggagcaccgacggcgcctactacaacttcgtcaatgacaagatttcggttccgtcccgcgaggcgttcaacagcaattcctcgtttctcgcctcactgctccatgagatgggccattctacagcgcccgcacttgaccgtcagatgacgggtgacatgcgcagcaaggaatatgcacacgaggagatcgtcgctgagctaagcagcatcttcagctccgtcgatcttgccgtcaaggccgagaccgaccccgaggccgccggttatggcgagcatgtcgcctacctcgagttctggaaggggcgtctcgacagcgtgaccggcacggacgaatatgaggcgaccaaggaagaactctgtgacgatttctttgccgccgcttcccaggcatcgcaggcgaccgacttcatcatcgaccgctacgagcaggaagtcggacatccggcagccggcaaggagatcgtgcagaagctcgatatgcccgaaaagacggaacaggaagaccgcgccgaccgcagtctctcgcacaagaaggaaacggctcgcgacgcgtctgcccacatgcagggcgaccgcgcagaccttgtgaacatgcgcgatgaaaatgccatcggagcgtaagcaaaggggaatgggcaatggctaagtttgatttcaataaacccgtcgccagtttcagctggtatctgcagaacggcagcgccgatgacaaaaggggtaaccgtctccacgtcggtaccggacagaaagcccagatctatttcgacccggagagcggtgagttcatcggcaaactcaaatatgtcgacgactatatcgacctcgcggacggcgcaaagcagcatttcgagctgccccgcacagcccgcgagtataaaccgagcgatttcagtccgaaattcccgatctctaacgtcaaatttgaagtagatgagtccgtgaaggattttatccacgtcctgccgcgcggtctcttcttctaccagaatgaattctacgatgccgtcttcggggacaagacggactacccggaatcacttaaggattttctcttcacccgcacgggcgacatcgaggccgccggtgaattctatggagcaatcgaaaagtggccgcagagcgtctactgcaccctcgtggaaaagtgcaatgtcgaaaaccgtcccattccggaatatgagaacgatcgggctctgccgctcgactaccataaagagctgctggcgtcccttaaagatcatttcggatgcggagagagcaattacaggacgccaggcgacctgatcgctgccaggagctacggctcatatctctccggtatctcgcttaagttcaatcctcaagacgttatcgcggctgtagaacatgctaccgagactgttcaggccgagccgttttagcgatttgcaaccatagaacattcgactcgtatcagccaccaacggcattccgaaacgcggcatcctgacctgctcaaggttaccacagctttcgaaaaggccttgagctgcagtcgtgcatgtcgtatccagtttctccagatcggctgcacagagatttttaaaccggttgaaccaatggcagagtttcctcggttttatcccgccgtccgcaacggaaacaccggtaacgcgatcagcgatcgcgtcagttgtccagcaatgatcgttaaaattttcgaagaccttcgttacatgctttccagcaaattctgttcccaacacaggaatgcgcccatagcggtaaaaggtaagtgattcatcgtctacggagtatacggcaaattgcctgtcagccatttcgattcctttctctcggcctacggcaatatgattgcctgacaaacgagaagctcttgaaaccgcggaatctatggtcgaaattgtttcagatgaacgatatggacaagccataccactggtttaaatctatccttacattcagtcccaccataaaagaccggactttcctgtttgcaactccccaggttgaaacgtggttgtttgacaagaggtatgcgattattgaaacggcacgtgaagcgggctatttgcaaaggcaccgcgacgtggaaattggtaaaatatcaaatcgatcctcttgaatacgctgcaagacttgcagccggaaaaggaaaggaatgatgcaagacatgaacgaaacagacaacaagcaaaagaaagggggaggcatgttcagcaagatcaaggccgtcagccgccgcgctgcgaccgttgccgccggtaccgtgctcgttttgtcgcaatgcctgggcagcttcggtgccgcattcgcgccgagtacggcctatgcagatacttcaactaagacggcaaccgtcaccctcgccgataccgagaacggcagcctgtcgtttgtcggcagggacgacgacaccaagaccattacggtaaatgtcggcgagacggtcgcaatcaaggcctctcccgccgacgggtatttcgccgacagcctctccgtcttcaataactccgataacgatgcctccgccgtctcgctcaaggacgggatcggcaccttcaaggtgaccggcagcgccaccgtttccaccatgttctacgagaacggttctaacggctcctccatcctcaaggccgtgaaggtcaaggagggtaaggccaacaaggctatcgatgagaagacctatatcaaggagaacgccgattccaagtacgtcggactcggcgacaagctggagaagaaggatgtactcaccgtgaccaccacggtcgtcgactccaacatcctcccgaatgcctctctcgataacctctgggccgacgacgacggcgatggcatgtcggaccatgcagacgcgctgcgagcaaatgcagtcagccatgcgatcctctatgacctcaacgaggattccgactactatgtcggctacgccggctcccgcatctccggtgccacccttgccgattggggcgcctccgagaacaacgccgacgccaagatgcgcgacggatttgtgttcgacgatgccaccggcctcatctatgtgccgaagaagtataccgagaagaacaagaagggcgaactcaaggtcgcttcctcccgtatccagctgctctatgcaactgcagacaagggcgcagagaacagcatcagcgtcaagatctccgaggacggcgtggacggggatgtcgccgagaacggaaccgccaaggtcgatatcctcgccaccgacacgaagatcgttctcgccaaggacaaggccgcccgcgagtcgctgaaagacagctcgatcgattccgtcatcgcgaacggcatcgagtacacccgcgatatggacatgtggtcctacgatgagggcaccggtacgctcgatctcaaactcgctccggccggtgttcgcaccgtcaaggtcaagctgacgaacgataccggcaagactgtcggcaactttctcacctctatcgccaccaaggcattcgccggtaacgtgaacaacatcggcacctggaagttcaatacggcaccatatgtcggcatgaccttccacaccgccggccacaacaagtacaccggtaccgcggccggcggccataccatgccggcagtcgagaacccgtccggcggccgctacgaggcgaagaccatctaccaggcgctcggcacccagggcgtggacgtctccgccctgcagtccggcaactactccatcgagcgcacctgcacgatcaacgcgcagaccacgtcctccggcgtggagattcccaacgccgcaaacctcaacctgacttgcggccatgtcggcgtcaacccatccggccagctccagaatggctacaaccagccgaagtacaccgatgacgattacggccagaccgtccgtgtcgctgccgtgtacggcaacgaggccgtcgtgggcgtcactgtcccgaccaccttcacgcaggcaggtgccggcttcttcaaggtcaactggcagctcaacaaggtcaacgtgaccttcagcaagatttccgccgatgccaaggtgacgaacggcaacagtgagtactcctatgcgggcgccgagttcgatatctaccgcacccgcgacaacgcgctggccgcccatatcaccatgaacggtaacggccatgccaactaccagctcgacccgaacgagaactattacgccgtcgagaccaaggccccgcagggtttccagaagtacgagggacgcatcgagttctcgaccggtaacagcgccggggaacagcagttcaaggacgaccctgggtatgtgaagattaccgttgcaaagaaggattccgctacaagcggtgaccctcaaaccagcctttcccttgaaggtgcagaatacaaatgcacttccatctcaacccctggctgggaagcaaccggaaagacggatgtaaagggtgttttgcggcttacacaagttccttttggcgaaattcaaatcgtcgagaccaaggccccttctggatacaagcttgacacttcagttcacacttacacagttcgtgcgaatgaagtaactgatactggcactatcgagcttgagccggaggatgatttcgccgagaacccgcaggcgttcgatgtcgagatcgccaagaccaaaggcggcgaggacgacagctgggagtccgacaacggccatggcaagcccgccgtcggcgtgcagttccagatcatctcgaactccaccggcaaggtcgtcggcacgctgaccaccaacgagagcggattcgcctccaccaaggattccgatacctgtgacgagacctccatctccgaggataagacggatgatgcaacccgtccgtggttcggcgagggcaagcgtaatgccggcatcgacggcgcgctgccgatcgatcagaagggctacacgatccacgaggtggattccacggtgcccgagggttacgaccatgtcgatgactggactatctcggcagatgaagaggtcaaccagagcacgaagtactactccgtgatcgacaagacgttgacgagccgactccagatcgttaaatgcgacgcggagacgggcaacacggttctgctctccggcttcaagttccagatcctcgatgctgacggcaaggtcgtatcgtttgacgacccgtatgacgtgaacgccaaggttgacacgttcaccaccgacgcgaacggtcaagtttccatgcccggaaagctgaagtccggcaagtacgccgtcaaggaaatcgccacctccgccccgtatctgctcaacagcgagacggtcggtttcgaggtctccaaggactacaaagacgcctctcccatcaccgtcgtaaaggtcttcgacaggcaggtcatggggcaggcgaccatcaccaagtcctgcgccgatgacggcaagaatctcaaagatgcagagtacgatgtcgtcgcgcaggagaatgtcgtctcccccgatggcaccgtgcgtgcgtccaagggacaggtcgtcgaccatgtgaccaccggtgacgatggaaccgccaccaccaagaaactttatctcggttccggttccgcaacctatgccttcatcgagaccaaggctccgaagggccatgtgctcgatacgaccccggtcgagttcaccctttcctataaggacgacaagaccgatctcgtgaccgcttccgtagagcagaaggacaagccgaccaaggtaaaggtcaacaagaccattctcggtaccgatgatgtcctcgccggcgccaagttcgacatttggaacatcgatgaccaggagaccttccagaccggaacttccgtcgcaatccgcgctgatgagggcaaagaggtctccgtcaagcagaatgtctcctcttccaccgtcacggtcaattcgaatgaatattcgattgtcctgaaggacaaggacggcaaggagatcgaggtcggaagcgacacggctgtcgaggctggtgactacaccgtcgtggctaagaagggcgacgatgaggtgaagctttccgacgccacgatttccgtagacaagggtaagtcctataccgttgccatcaagaatcatatcttcggaacttccgcagaactcagcgagaccggtgactcggtgccgagcgtgaaactgacgtgggatgccgcccgcatggcatacaccaccgacaaggcccttgcctccggcaaatacaccgtctccgtcgatggtgtcgcggtgggaaagatttccgtcaagagcggcgagatcgcctacgcatccatctccaatgacacggtcaagcgcgagcccgtcctcctcaaagacggcaagaagttcaccgagcgcaccacagatgtaaagggtgagttcgacgtgaagcacctcaccaccggttcctaccgcatggtcgagaccgaggctccagccggctacatcgagaacccgaacgttttcgccttcacagtcgattccgacggcatgaccgagggcgtggccgagtacacgatcgatgtcacggacgactacaccaagctgcatgtctccaagcgcgatatcacgaatgaggccgaaatcgaaggcgcgaagctcacgctcaaggattccgatggcaaggtcatcgattcgtggacttccaccacggaggaccatgtgatcaatgccctcgcgcccggcaagtacacgctcaccgaagagcgcacgccgcacacttatgatgtagcggagtccatcgatttcaccgtggagaagaccggcgagatccagaccgccgtcatgtacgacaagccgatctccatcaagggcgagatcgacaagcgccaggagatcgctgaccccacgcatccgtatacggaggctaacggggacggcgagaacaacgccgataccagcacgtcagatgacggaagctatgattacaccctcgatttccgctccacctctaacacctggacggatgagttcaccgtcgaggacgacctttacggagtcatgaccggtaaggccaccctcgattcgatcacgaccccgcaggcgtacaaggacttcgatggcaagatgaacgtctggtacaagaccgatcagacgccatccgattactccgacgaatccggtgccaaccagaccctttccgacggacacggcaacccgtggctcaccgacgagtccaattccgaaacccttggcgaagacggccgcaagattgattacaccggctggaagctttggaaagccgacgtgtccaccaccgaggccgaggaccttaaggtatccgacctcgagcttgccgagggcgagcacgtcactgcaatccgtttcgagtacgggcgcgtcgaatccggcttcaccacgcgtgaggacgattggaaccgtgacggcatcaaggactcccatgatgacgtgaacgacgcgaccgagaccgccaagggcaacggttcgtactccgatggggtctccatcctcgtcgatctcgacggctccggcaagttcacggcattcggcaataacggtctcggcggcaagatcaagcagaaggatggcacctatacctgtaaggacggggataccgtctattccctcaccctgaacaaggacgggtccgcctccgcgaagatgaccgataaggacggcaaggagaccaaggtcgacctcgccgccggtcaattcaagatcagcgagggcgtttccggtgactatgcaccggctatcgtccatatgaaggtcaccgacgattaccgcgctggcgactccttggagaattacgccaaggtcgacctctaccgcaacggcggtggcgaggaccagctcgaggaccatgacgatgacaaggtgaagcagaccccgaagtccgattccgccatcatcggcaccacgctcaccggcgaagacggcaagcacaccgtcaaggtcggcgagaaggtcgagctcaccgataccgtctcctacacgaatatcgaggcgggtgtcgagcataccgtcaccggtacgcttatggataagaccaccggcgctcccctctccgatggggacggtaacccactcagctcgagcgtcaccttcactccggaggagaaggacggcaccgttgaggtcaagttcaccgtcgatacgacgcatctggacggccacgatctcgtggcattcgagacgctgaccaccaaggaaacggaaaccgacagggagaccggcgagaagacaaccgtcgacaagaccgttgccgagcacaaggacatcgacgatgcgaaccagaccgtcaccgtcaccagcgacaagtcctcgatggctcaaaccggccgcaacatcctgatcggcgccgcaatcgcggctgccgtcgccgccggtgcgggcggtacgtatatctaccgcaagcgccatcaaatcgatgacgccgacgatatgatggagtaacctttaagaggggcttccatcgcctactgaaggggctattcggggtaacccggtggcccctttttcactaaaaaggaaaggaactgaatatgacgaaaagaaaaaggataagcagaatcgttaacgggatactgctaggtatctgcatcctatccgcggccgcagcccttctgctgggaggagagacggttaaagaaggctgggaatacgatagcctcgcaaaggacgctgaggttcagacggcagacggaatcgactggtccatgctccgcggccgtaatcaggatatcgcggcgtggctcagggtcgagggaacaactatcgaccttcccgtcgtaaatacacgtaagggagaccccgcggacttctatctgagacacgatttcgaccgtaacctgtcattcgccggttgcccatacctggacgcaaggtgtacggcagacggtgcgcacgcactcgtatacggacaccacatggggtttaccggtcagatcttctcccctattttcgcgacctataggcaagcggaattcgacaagatcggcgagatgtattggttcactcccgataaaggacggcagatgctcaagccggtcatggcgatgtcagtcgacaagaaataccagccaatccagacgttcgatttctcttccgcagaggaagtacggtcgtggctttcggatatgaaaaaagatgcgaccgccgtcagcgatgactgcgacgccacgattgcaaacgcaacccgcgcaatcacactcgtcacctgctcttcgatgaatacgggcggtcgagcgagaacgcttcttattttcgcccagtaaagcctttgacacttgtaccacagtacaaacgtggtataatactacatacacgaatagagctatttctttcaattgagctaaaaataactcaaaaaaggaagttaaaaacagcgctattgtggtataagaactatagatatagttacgggttcagttttagaaggcgatacaatggacagcgatattccaccgatgcttggaatctcacaagtcaaacgggatttctcccgcatcgcaaaagacgtgacgacgactggaaagccggtcgtcgtcctgaagggaagcaaaccgatcgtccagatcgcaccgctcccgaattcatccatccaggatgaagcaccaaagacagcataaggaggatatgcaaatggatgatatgaacattaacaacgagccgcccgtttacgacagcggcgatatgaaaccgacaaaccccatccccaccgagggcgagaacgatgccgggctcaccgaggaacttccgatgtatgaggatacgccgaccggtgaccgaggcgggcgcaagaagatcatcgcgatcgccgcaggcgtcgtgctcatcgccggtctcggtatcggcgcattcgcgttgagttcccataagacagcgaacactcagccggccgagcaggagcaaaccgtcacaccggtcaaggacaactctgaggaaaagacggacaacctatcgacttccgatatcgccaagctatgctcgacgctcaagctggacgatgccgatctgtcgatcgcttctgaccaggtacgggtcgatgccaaaagcggccgcgtactcgtgacccaggtttccgaggacgatgcagccaagatggtcgattcgactgcccgacgttccgccgccctcgctgccgtactcaacggaaagaaaatcaagggcgtcagtgccgtcgatgtgacgtgggttgccactgacaaggacggcaacatcaaggtcgccgtcgcatacgatgtcacaaaggcgccgaccggaggatcaacagtcgacatcatcaacggatccggcggacatgtgatcgccgatgacatctggtccaccgatggcgtgcatgaccagggctatgaccagaatgccggtaccgtgaacaagccggacggaacccctatctcgactggaaccaagaccgaggagaagaaaaaatccgacgacaaggaccagaagtccgatgactccaagaaggaggataacaagtcttccgattcctcgaagtcggacaacaagggcgattcctcccagtccaagcagaattccggcaattcgcagagttccggcagcaacaattcctcttccaacggcggcagccagaagaagtgggttgccgagcagggccactgggagacagattacagccaggtctgggtaccgaatgtagtgtatacgcgccatgaacgttggatgtgctctgtatgccatgcaacgtttaactcagcagccgaaatggacaatcatgttttctctacctacggtgatgcacaacaccctaatggagcttctgcaatcaatgattcgtataccacctctgaggaccagggacattatgaacagcaggctacgggacagcattgggttgtcgacgtcgccggtcactgggagtaatggacattcgttccccttctcttacattcggtgaatacattgtaccatagtactacggtgttagacgtgagaatcatatagctgcataagaaaagacctcggagtttgatccggggtcttttttgcaggacgaaatgatacctgataaaatcagcaaaggcgcggagtgcgctgaagccctacccgagttttcggggaggtggtcatatggacatgctacgtcttttagtcgttgctctcctgcttacgaccgtgcagatcattctgggtcgttaaattcgacctattaaatgactgaagccgcccctgcaaggacgacttcagtgacgaggtgaaagcctcaaaacctgtttctatccacgtagggcgccggttctgcaaaaccgttaagcgcaccctcgcgtcatctttagtatagctgctaccaatatttctaccggttagttttgaaaattcccaaaaactttcctgcaaaaccaatcattgtcttccgtgataacccagaaacgatatctgaagtctcaattcttatgccaatccttttttacggcgttgagtcattcggcacgcttgtgagcagacatcgttcaaggatccgattccactttgaaggaacggtgccccgcaattccgacaaatgccgatcctcagagagtccctgtagacaatccgatacagcaattctgcgaacagggaattgcgtttcaaactcggcatcggacgatcggaaaaccgtgcagatgtgtcagcttcccatcccaggtttatctggccgcctgaaaccgcaaggttcgagacggagccaatcagcgcgtttatgatgttttccgcatcacttcgttgcgaacagccaacttgagtacaaagcagatagttcctttctgccttgtcgtcccacccatcgaataggccgatatatttgtcggaagaagttggagacttgacactccccgtagttgaaaccaggggattctcagttctgcgaggtctgccgtcgaggaccgatatagtcctctagggtcttacgtcctctccccgagcgtttaggcggctacagccgccacggttcccgcgtgccccgcggtaccttccgtgttggagaggatgcgtttcccctccgtcagtatgtttctcgccgcattgacgtcgcggtcgtggtgcgcaccgcacgcggggcagtcccatgaccgtaccgacagcggcagggcgtcgagcctgtgcccgcaggccgagcaggtcttgctcgacgggtagaagcggccgatcttgacaagggagcgcccacgctcggcgcacttgtactcaagcagccgtgcgaactcgccgaacgaggcgtccgtcacggctttcgccagacgacggtttcgcaccatgcccttggcattcaggtcctccatgcacaggacttggttctcgtccgcgagcatggtcgtgaccttgtgaagggcatcggttctggcatcggtgatcttcgcgtggacccgggcgacccttttcctctgcttcaggtaccgcatcgactgcttctcgcccctgcgtgcgcccttcctgcgggagagcctacgctgctcccgcgcaagcttgcgctcatatttcttgaggtggcgcgggtttccgatcttcgtgccgtccgagaaagtcgcgagcgttttgacgccgaggtcgattccgaccttccggtcagtcgcgggcatgtccttggttggcacgtcggtgcagaggaaggtggcgaaataacggccggccgcgtccagggagaccgtgaccgacatgaaacgcccctggagcggtcgggataccttagcccggacagtcccgagcttcggcagcgcgatatggttgcggtcgaggaccttgccgccgttggtgcggtacgactgtcgggcgtgccggcgcgacttgaacttagggaagcccggcttcccgccctcgcgcacgcgtcggaagaagttcttgtaggcgcggtcgaggtcgcggatggactgctggagcgccatggagtccacttgcgcgagccaggaggtctcgtggtcgcgtttccatatcgggagcattcgggagagcgccgtccacgagaccgtcttgccagtcttcgcataagcggacttcttgacgtcgagggcgcggttgtacacgaagcggcagcaaccgagcgtccgcgcgatctggtcgcgctgtgactcattcgggtagattcggtatttgaatccgcgttccatcggctagacctccttctgtctctctatgtatttcctcacctgcgcgagcggtgcacctcccacggtcgacacgaagtagctgttcgtccagagcgtcggtatacggcttttgagccacgggaactcctcgcgtaggtcgtggcttgacctccccttgatgcgcttgatcgcccggtggatgctcagctggggatcgattgacaggagtaggtggacgtggtcgggcatgacctccatctcggcgatctcgaacccgagctcgtcggcgacttcccacgcgatctccttgaagcgctcgtcgactccgtccacgaggacgggccgacggtacttcgggcagaagaccacgtggtagctgcaggagaaaactatgttgcggttactcttgtacttcatggtatagatattatacagtattgagctgcataatatctaccgtcttatatccccatagataaatccaggggctttacgacggtttcggtaaaatcgcttgtcctggctgcacgcgatctcggacccatgtacatttcagcagacatcctctcacgtcgcacttttatacctagccatctccagcaagatattgaatacgggtttaatctcattccacccaatctagagagcctgctttcggaatgctatttcgatccatacgcaatccccgatgagatagctggtatgggctatagggcaatcggccgtacgggaaagaaggcgacacgagagcttatcaacgacttcgacttcaccatagccggggatctgtcctatctggattcgcagtttcgtgcaatcgtcgaaccgctgcacgactgggtctttgccagaaacctgctttcgatcctcatgcgcatcggcggattatacagatccggcgccgatcccgacactattctggaagccgcacggttccgtcaagtgaatcccatggttctgaaaaaacgattcaatatagatacggacacctgctatgcaatccccatcgctttcaatccgatctatcgaatggaaaacttagcagacaaggatatttccttcgatgctctgcaattctgcccgctgtacggcagccttatcgataaaaagaattcctttagccgaactgcggttgaaaaccatcttaaaggtcccggcaatgaattcgtgaaattccttgcgccgttagaggcatcacgggtcaaaaacagattggacaatcatgaaagccattccgaggaaaataaatggcggtatatggtcgtcagctcaaacacagacggcgaggcgataaataaccagatgcaactggcaaaccgcttgcttcaggcatttgacgggatactttcccagcctcaacttctcacgtgcctgctttcgtttcgccttcttgtgatctttgataagcatcgtgatgatagtttcaatgccccagagaacagctgcgaaaatcaggataggcttaaaggcatctatgataggggaaaggtaattgccttgcatgttagtcacctgaacattcgctggtcgctgtgatcggacagttcgccgccacctgttaacttttcgagtgtgtcgtacgtatcatcattgtagcgatatatgtaggttctccttgatctgatcggatatttcctaaagctttgagagtacttgtactcgcttaacctgatttgttaaacaaaatgcgtaaatctggttaaatgaaacctgtaaattcggttaaacgcgctggtaaaacaggcggtctttgtttaaaagcaatgacattaaatgttcctgaagtccatctcgcagttttcgataaattcagcactctggatagggtaaaatgatgccgacggcagcccaagtcgtaggaagctgggcagagccgttgcttagtagagttaggtcatcgtcttagcgacggtggcctttctttttgggcttcgaaccctgcttgagtgccttggaaaggccaacaagcgctgtaagaagcatcattcaatctgttgttttaattaagtcccacccacgatatgcttgatgaagaccctaggatgaactcacatgagagcccaagcgtacggtggttttatccgcctaaagaggataaaatgaaagcagaaaacgacgcatcccgtgtaagcaacatggagcgcgggcggcctagttttcagtctttgttaaatgcccgggctccgacccccgggcattcttatttgcgcttgtggcgcaaatgccgtccactgtccgcaccgcgcgtacgcctacggaccttaatccgaacctcatacgagtttaaaaacgcgatgatgaacgtgccgaccgttgcaagagcggccagcgcgttaaggaatttcagcatatggtgacctccgatcaaatcgtcggccgcccgcgcacggaatgtgccgtggcatcaattctaaccgaacctgcgactgccccagttaactggtacacctctgttattgttcatattcaacgtctcaaaacgtatagggattgcacctatcgcaacgataaggcacggcgagaagcgcagcgcctcctcccccttcaatgatttatttctcggttaccgctttaccagccaaggctgaatctccttttcgagggcaaggtaatcccaccgcagctctacggcgcaagcgtgtcaactggtgcaacgatgacgccctctggcatcgtgtgcgccggcataccgaacccgatgacgatgagcttggatgcgggcggcttcttaccgcgctcaaccaactttcgctccagccgaagcaggtttgcagatgcctcgggaatctgggagcttccaagttttacttccacggcaatccaggttccatcgcgcctgtgaatcacggcatcgacttcgagatcatcggcgtcgtggtaatgggataccgatgagtcgtttacagcggcatagaccttaaggtcgtgcaggacgaaggattcgaagagcagtcccagtgttttcgggtctgataccaatgactccggatttgctccgagcagcgcgacggcaagtgaagggtcagcgagatgccttttcgcgctctgtcgcagtttcacaggcgacctgagcgctggatgccaagctggaatatcgtcgatgatgtttattctacgcaaggcatccatatagcgccgcagtgtgctcctcgatacatcaccgccgaggtccttctcaagagacttttcgccggcaagagtggattcgttgcgggcaagtgaagaaagaagagccctgactttctctggatcacgcttcacaccgtcaacctttgaaacatcagattcgcaaacaccgtcgacatacgcagaagagatacacatggcatcttcggttgacctgccaacggcttgcggccaaccgcctcgacacaccaagtctgcgatggcagagatgccttcaattgatccaagagcaaccccgatcggcttttcagcgaacagtgttccgagggagaccgatcccgatgaaatgccgagctcgaggagagtcatcgtgtccatacggagtcgagacacgcgcccaactccactgtgcataggttggcttgcggcgttcggcgtagcagacccagttagaagaaactgtccgggttcacccattcttcggtcgcactcgaaacgcactgcatcccatattttaggctcctcctgccactcatcgatgagtcgcggagctgagcctactaccgcctgggcgggatcgagtcgggcgagttgaagtgccgcaaaaccgccggctggatctgagagggacagggaggacgctgcaaaacgttgcgccgttgtagttttcccgcaccacttcggtccctggataagcacggcaccgaagatactgagatcgcgttcaattaaacgatcgatgcatctagctatatacctattcatagaacttcccgtcgttcattgagtcatcttgttttatagcattttaccagcacgtgaaacattctgacgacgtcacgtgaaacaatctggcgataaactgtgaaacaatttcggaactatcgtttcagcacgtatgccgctgtaatcatacttgtacttgtttaatctgatttgttaaacaaaacctgcaaattcggttaaacgtgctggtaaaacaggcagtctttgtttaaaaacaatggcattaaatgttctaaaagtcgatctcgcagtttccgataaatctatcactctgaacagattaaaatgatgccgacggaagcctaagttgtagagagctgggcagtgccgttgcttaacgaagttaggtcatcgtcttagcgactgtgacctttctttttaggcttcgagacccgtctttgattttcccgtagttaaaccaggggttttacgacggttatgataagtcccatccacgatatacttgatgaagtctgaagctccctgaaaggtgatcacaatggcccatatagcgaaatatcaatctggcgcgatcggtcacatgtgcgccctttacgagaaagaggcgatgcaagccaacggttacaaccttggtcccaaaaggctcatttcccaagtgcagttcattagcgagcgaatttccgccctcgcgctgaaacgccatgtgcgcaaggatgcggtgagtctgtgcgattgcatcgtcacgctcccccgctctttcgatgataatcgcgaacgcgagtttttcaagacggcatatacatttctatctcagcgttatggtgtcgataacgtcgtatcagcctacatacacaggaacagctcccgtccgcacatgcactttgcctggataccagttaccgaggacggtcgcctttcggcgaagagtgtcgtgacacgtcttgagcttaagacgctgcatcccgacatgcagtggttcatggaatcgtcccttggatgtaaagtcgagattcttctcgattccgaaaaagccggcgaaagaatcctgagcgggttggggttgaaggactacatagatgcaaaagccgagctggaacgacttgacagtgaaattgctgtgaaaaaagctcagctgaatgaaatcttgcgtcaggaacatgaggcgcgtgagcgtcttgcggagcttattcgctccgccgagcaagaagacgctaagggagattgagaacgcgagaaggagaggttgctgatggagtacaggcttgcaaacggatctgcgatcacggacgaagatattgagcgcgagtgcgcggaatacgaatccggctcctgggaggggaacctggtgaatctctgcgccgaccgctccaagctttccgagggggagcccaacaccaacctgtacttcaagttcccgaggacggacgccgatctcatcgaggaggcggccgacataaaggcatacaacgaggcgctaatggaagacgatgccacccgctattcgatggatgacgtcatgcgtatggcaatggaggccgagtaagcttcagcgtcgaatggtctaatcgcctcataaatagaatcctattaagccgtttacctgctggtttgtgaaatttgtttttggagcgccatggtcatggcaaagcgagatccagaagacacctaaacctcgctaaatgcccaacattatttggacaacagccttttcgatgccacataagtgtcacccgtgttattcggaatgtcttgcggcgcgtatcccttgccagtcgaaatgctataccacttgccgtctgccccactgatatattttgaagaaggagccggcagataggaatttgttccctcaccatcgtcatagatgacccatttccaattagaaccgagactgactttggacagcgattggcaattaccgaacattttgttggcactaacgactgaagtgaaatcgaagccggaaagatcgagagattgcagagacgggcagtcgaagaacattccgaacattccactacgggatgcgtgtacggaccagtctttcatattgatgctctcaagcgaatggcactcttggaacatacagttgaagttccaggtttttgaaacatcccatgaggaaaggtcgagtgacttcaatttcctagccctgaagaaagcggcgaacatctgacgacactcagacgtgtcaatctttgccacatcgacggttttgagattggtcatgtttgcaaaccatacgctgacactttcgggagcgatgccagtatccacgacggtgaccgtctcgatctgcgactgatgagcggcccaaggagcgtttgatgagccatagcgatctgtgggcgtctcgacgagcgtatacgtccccgtctcaaaccccgtgtacacctcggtcacggtcttgaactcgaacttatcgccgacttcaggcacttcggtgcgtttgtagaaatcaagactgtgatcgtcggcgctatacacggcaaatgcggtttcggcctgatcggctgaaccagcgccaaaaacatcctcgccgctaccgaaccagccgccaatcgtatcgcctgtctcattgacctgctgggcgattttggtgccgaagccgagtagtcccgcgccgattaccacggcgacaatcaggacgatgacgtattcgacggtaccggcaccggactccggatacgtcctgcatgaccgttttttagtggggggggtaattctgggcaatgataacatgggcgatctcttttcgatgatggtgaaattcccgctcatatcctgatattcgttttgcaagcactgtggataatgatacaccaaagcccccggcgccgtccgttccgtcctgtacgtgtacggctggtggaaggaatataagcggaacggatagcgaagggagaaaaaaatagcacggctggcaccgggctatcaattcgtctgtacctgcgttgcccgcgttccagaagtttgactagctaaggagcgggtttcgcggcacaacctgattttatcacgcatcgactagttctagcggtgtgacattcaatcagctgttataatacagatctccggctttggtgaagtcgagctgccctagcacgttgcaattcaatcaactgttataatgaatttggtgaaagcaccgtatggtacaaggccctagtgcgttgcaattcaatcagctgttataatcgctggactcgggtgcagccaggagcagttgccctagtgcgttgcaattcaatcagctgttataatggcagtgagctcaaggacctcaggcttaccgccctagtgcgttgcaattcaatcagctgttataatttgggcggcttacggttggtcgcgtcgatcgcagcagcacagaagttcagatctgccatggtctctcctatttctctgaatcgagacgcgtcagctccgtgacgagtgccttggcaacctcggccatgagcggcacggcaacggagtttccgaactgcctgtaggcctgtgtgtctgaaacgggaatctcaaagtcctcggggaatccctgcagacgggcgcattcacggggcgtgaggcgcctcgggttcttgccgtcctggggaatcaagatttcagaaccatccttgtagtagcgtgcggaaagcgtgcgtgagtggcctgccgggtcagccatgccgtagccgaagccgtttccagctgccttgtgcttggcggcataagcctgaaggtacgcccacagattgtcggtgagggtgtacttctccggcatgtctacatcgaggatgtcggccaggcatggcttgattttcggttttggcagttcgaagtcgaatgttgcgcgaccgtcgtagaaatctcgattgaagccgatcagaacgatacgctcgcgatgctgtgggacatagtcctgggcatcgaggacctggtagaacaggtcatatccgatgccgtcaacagcatcctggataaccctgaaggtattccccttgtcatggctcgtcagatttttaacgttttcgagaaagaaagcctttggtcgtttctcggctaagatgcggcaaacatcgaaaaagagggttccctgcgtttcgtcctcgaagcccgttttgcgcccaaggctgttcttttttgagacgccggcaatcgagaagggctggcaaggaaagccgccgaccagaatatcgtggtctggaatatccttcgcatcgacctgcgtaatatcgtcgtccggaacctcatggaagttggcctcataggttttccggctgaacttgttccattcgttgctgtagacgcatttcgcgcctgtcgattccatcgcaaggcgcaggcctccgatgccggcaaaaagatcgatgaaggtgtaactcacttttatctagattcccaatcaaacacgtcggacatttagtcgactactttaaaaaacatgttcggcaattggtcggtagttgtcgaacaaacaacgactaaatgataaaatcgctggtagatggtgaaaaccgaccaaaaatcgaccatttcaggataacactgaccaagccctagtgcgttgcaattcaatcagctgttataatctctatctctgacttgagcgctcgcgtgggccctagtgcgttgcaattcaatcagctgttataattaagaaccttcgccatgtcccacgcatcgagccctagtgcgttgcaattcaatcagctgttataatacccaccaacgaaaaagccccttaagcaggggctttactgttatagaattatgaaaaacgcggaaatccggtcatttttcggctcgattcacctgttttttgaaaaaaggagatcacctgcgacacaacctatagatgtgtcgcaggatatactccacgagtgacttgcgatttcgcaagccctcttacccaagcgttactcgttgcaattcaatcagctgttacgaataggaacaagaagaacttggtataagtaataataccaggaaaacaatcaatttgaacaataatcccgaccgccataaatacttcagcaaaaatggagccgagatgttacaaaccgttgcaatcagaacaccaaagtatctttgcattaaagataattccctcattatccgggaaaagggatcgtcggtagttctcggtaaaattgcgctgtcggatatatgggtcatcattatcgacaatcctcaagtaacaatgacaagcgccctgatatcgggcatcaacgatgccggtatcggagtcttatactgcggctcagaccatatgccaaacggactcgcactccccttgggggcacattcgagacatgccgagatcgtcgagcaccagctcgctatctcaaagccattgcgaaaccaaatttggaaacggctcgtcacgaagaaaatcgagaaccaagctaaagcactcgcattgtgcttcggtgactcggctgaagttaaaaaaatccgcggctatgcccaggaagtccaaagcaacgacaagacaaatcgtgaaagtatcgccgcaagtgaatacttcaaggcacttctaccatacgggacacgttggaatggccctatgacagccccgcttaactacggttatgcgatcttgcggtcaggcatcgcccagtgcgccgtatcacacggctggctcgtttcaaggggcatacatcatcacagcgctgagaatgcgtttaacctagtcgatgaccttatcgaaccgttccgtccaattgtcgatctgaaggtcgtcagtgataatattctcgaacccttgtctacgcagaataaaaaagcccttaccgagaccgtcgtaaagcccctggtttcaactacggggatatgagacggtagatattatgcagctcaatactgtataatatctataccatgaagtacaagagtaaccgcaacatagttttctcctgcagctaccacgtggtcttctgcccgaagtaccgtcggcccgtcctcgtggacggagtcgacgagcgcttcaaggagatcgcgtgggaagtcgccgacgagctcgggttcgagatcgccgagatggaggtcatgcccgaccacgtccacctactcctgtcaatcgatccccagctgagcatccaccgggcgatcaagcgcatcaaggggaggtcaagccacgacctacgcgaggagttcccgtggctcaaaagccgtataccgacgctctggacgaacagctacttcgtgtcgaccgtgggaggtgcaccgctcgcgcaggtgaggaaatacatagagagacagaaggaggtctagccgatggaacgcggattcaaataccgaatctacccgaatgagtcacagcgcgaccagatcgcgcggacgctcggttgctgccgcttcgtgtacaaccgcgccctcgacgtcaagaagtccgcttatgcgaagactggcaagacggtctcgtggacggcgctctcccgaatgctcccgatatggaaacgcgaccacgagacctcctggctcgcgcaagtggactccatggcgctccagcagtccatccgcgacctcgaccgcgcctacaagaacttcttccgacgcgtgcgcgagggcgggaagccgggcttccctaagttcaagtcgcgccggcacgcccgacagtcgtaccgcaccaacggcggcaaggtcctcgaccgcaaccatatcgcgctgccgaagctcgggactgtccgggctaaggtatcccgaccgctccaggggcgtttcatgtcggtcacggtctccctggacgcggccggccgttatttcgccaccttcctctgcaccgacgtgccaaccaaggacatgcccgcgactgaccggaaggtcggaatcgacctcggcgtcaaaacgctcgcgactttctcggacggcacgaagatcggaaacccgcgccacctcaagaaatatgagcgcaagcttgcgcgggagcagcgtaggctctcccgcaggaagggcgcacgcaggggcgagaagcagtcgatgcggtacctgaagcagaggaaaagggtcgcccgggtccacgcgaagatcaccgatgccagaaccgatgcccttcacaaggtcacgaccatgctcgcggacgagaaccaagtcctgtgcatggaggacctgaatgccaagggcatggtgcgaaaccgtcgtctggcgaaagccgtgacggacgcctcgttcggcgagttcgcacggctgcttgagtacaagtgcgccgagcgtgggcgctcccttgtcaagatcggccgcttctacccgtcgagcaagacctgctcggcctgcgggcacaggctcgacgccctgccgctgtcggtacggtcatgggactgccccgcgtgcggtgcgcaccacgaccgcgacgtcaatgcggcgagaaacatactgacggaggggaaacgcatcctctccaacacggaaggtaccgcggggcacgcgggaaccgtggcggctgtagccgcctaaacgctcggggagaggacgtaagaccctagaggactatatcggtcctcgacggcagacctcgcagaactgagaatcccctggtttcaactacggggagtgtcaaggagataacttccgttctggtatcaatcgacggacgcaggcattccgtccagactgcaatagatatctactgtgaatccttgagacgggctgtcgagttaaaagatgccggccaattgctgttgccggacatcatcgggcttgaacgtgaaacatacgaagagaaacgggcgaaaggaaaggtatgagaatcatgcggctggtcgtgatgttcgatcttccaacgaagacgaaagccgataaggacaactacatcaaattcaaacgttttctagatgacgacggctaccagagggaacagaacagcgtctattcccgcaaccttttgagcaggtcatcatccgaagcccacgcagaacagctgcgtaaacatctaccgccggccgggcatgtcgtcgccatggagttcacggaaaagcaatatgtagaccggaaagttctcgtcaacacgaatccgtctaacgattgcgacgatcagagccctgggacgcagcttttcttggagttctaaattgcaatgggacgggtgcacccccccgtcccattgtgactgcccgttaaaccggggagttttcaaattgaccaacgcggtccgacaagaacttcaaccagcacaggccaagacaatcttcctgcataaccgtcagcgatgagtcccatttcgcctgcttcggaaatgactcatccgacaggggacctgtcttttggaggggtacgctcttctcaccaatctttgaataagagttaacaacgccgttcgacacgttatacatgtagtaacgcatcgcacagccatcttgcagtagcacgtccccctgcttcaggaaaatgcggcgctcgtcacctttcaactgtactttcggccagtaatcaatcgaaagaccttttgtaaattccctgatgaaatcctgcctgacattcggcacgtcgatgtaatagatgggatcgaacctccaactgccggacttcttcatactctcgtcgaataccgccatcaggccgtaagctccatcatacaatttgcatcctccgctgccatccttccataacgtggatgcaggctcgattttcccattacgccgataaagatcctttccacggtcgtcaacaccgacatagggatataccgtgtccttaagcaagctgccggtcgcggtgcgggaaaccgtccgagtcggtacgatgcagggaatccaagcctcgacctggtccttgaactcgggatacggcatggactcgtaacgaagcctctcccgctcctttatgttcgaccggccgctattgacccgtgcaatgcccttcacgatctcagggctgcagcacgcgattaccgcgccatcgaccgcatgatggcggtcgtcgcttcgatccttcttccctttttcgtcaacaaccccgatgccccaaattcgacgcatgagcgacgtcgcggcaccggcaacgcagaaaacatgctgcctcttatcatcggggaatggcaggcattcgcgcacccacatcgcaagctgtcgcgacatgtaccgcgtgtcgttcaggttgcgatcgatgaatttctgctcctctttcccgaacgtgctgtttttcagcttggaaagctttgatttcgtataatgcgcagacttaccctttccagcccacgcgtccatgcgaccgcaaaaatccccgaaatcaggcgccgaaggctcgccggaagtcatccattcatacggcgtgcggttcgccttatcgcggttgcttttcgtaaggcacaggaccttattggatttcgagtcatcgcaggaacgcgagaacgggaggatgtggtcaatctcgacataatcacggtcgttcagcatacgctccagattgatgcccttgcccgtataagggtcctggccgaattgctcacggtagagccacatcttctcgaaatcggtgctgctcacgtgggcgtcattcggaagaccgtagaacgcaacgaggtcttttttcacctgctcgttactgtccttattggccttattcgttgccgcgataatcgccttctcatgcttcgagcgcttgagatccttggccacctcgactcgaatgatgtcgggcattccataatgcctgataatcgaattgatcatgcggcgcacctgcgcggtcgcgcgaagcaccaccgggttcgtgcatgtcggatcgaattcgaggtagggacataacagtccgtctttactttcgttcctttccgctgccaatgcctgcctggcctcatatagaccggtcgccatctccgcatcgtacagtttctcaatctgcggatccttaaatgcatcgcggagcatctgcagagcacgaactcccgtgttgcaatatcccgaaaagagcttcgaggcgtagggaagatcgagcagagaatcgatatcctgctccgacagatcgagactgagattttcaagggcgtttcgcagtgattcacctgaagaggcgtatgtcagtgcggagcagacagcatcggctatgtcggtatcatcatgaagccaatcgagcagcgccctgttcgacgtgaaaagacccctgcagagggcattccaagccgggatcttgatacagtcgcccttctcatcggtcggcaggcggctgtcaaagctgtcggatgactgcatgccgagcttttcacgaagttgcgaccatttgagcggtttgggattcttcgagacggcaaacagggactcaacgatctcattccgcttctccggggagatgtatgtcgcttcccgaccctgatgctcaatctttatgttcgatagcttctcatacgcgcgcaccatctcaaaggaaatcaacgagcttgcggcacgtttctccggggctccgagataggtgcagtaaccgaccctgctatagattttcttatcgcgggcgctcgtgtcggtaagccagcgaagtgcggaaaggtactccccttccagctcctcggtagcgatatcgctcccaagatcgcgttggtgccggaagatggtatggacctcgtccgtcaccatctcgatgtcgaccatatagcgatagtcaccttccctgttacgggaagtaggctgcttcaaaagatactgggcaatcgtctcatagccgttttcatccagaatcttacggttttccgatagggcctttttaaccttaccggagtcgtcatcggtggtgcccttgccgtgatcgatgtatccgcgcctgccggcaaaagcgtagagaatccgggcaagctcgcgcccattcagtttatagaggagcgccttcccgcgaaggtgaaggacgtccggctcgcccttccggatcgcaaaccactgcccgtccgcatcatccggaatcaaaacgtacttcttttcgatatcgcggacagccttctttcggttctttcgacgtttggttgtgcgacgaaccgagcgatagccacgtcgtatgctcgcgccgctctggcgagccgaaatatccttctgcttgccctcgacaggcgccttgaaaatgtggctcgccataaggatgatctcgtgattgcgtatatcgatcaggcagactccgacacttgcaatgcccatatcgataccgagaatgagcctgcgcgttttggaagaatactgttcgtaaggcatcaacgccgtcatgaccgtctccggccggaatccgaaatcacgtggatcgctgtactccaccatagaccctcactttccttttcattgatgatcagatggtctaataatactacaagcaggtcatttttagttttccccaccgcgagcagacagaattcgatgcggtaaaatctagaccgacttagccacttcttccattggagaccaatcatgaaacgccaaatatttccaaccgcatctaaatatcccaccggaagctatcgcccacgttttaatggaaactcgctcgcatgctgcgctgccccatatgactcctcgactcagattccaagtctgggtgaaggggattaccgagaccgtcgtaaagcccctggatttatctatggggatataagacggtagatattatgcagctcaatactgtataatatctataccatgaagtacaagagtaaccgcaacatagttttctcctgcagctaccacgtggtcttctgcccgaagtaccgtcggcccgtcctcgtggacggagtcgacgagcgcttcaaggagatcgcgtgggaagtcgccgacgagctcgggttcgagatcgccgagatggaggtcatgcccgaccacgtccacctactcctgtcaatcgatccccagctgagcatccaccgggcgatcaagcgcatcaaggggaggtcaagccacgacctacgcgaggagttcccgtggctcaaaagccgtataccgacgctctggacgaacagctacttcgtgtcgaccgtgggaggtgcaccgctcgcgcaggtgaggaaatacatagagagacagaaggaggtctagccgatggaacgcggattcaaataccgaatctacccgaatgagtcacagcgcgaccagatcgcgcggacgctcggttgctgccgcttcgtgtacaaccgcgccctcgacgtcaagaagtccgcttatgcgaagactggcaagacggtctcgtggacggcgctctcccgaatgctcccgatatggaaacgcgaccacgagacctcctggctcgcgcaagtggactccatggcgctccagcagtccatccgcgacctcgaccgcgcctacaagaacttcttccgacgcgtgcgcgagggcgggaagccgggcttccctaagttcaagtcgcgccggcacgcccgacagtcgtaccgcaccaacggcggcaaggtcctcgaccgcaaccatatcgcgctgccgaagctcgggactgtccgggctaaggtatcccgaccgctccaggggcgtttcatgtcggtcacggtctccctggacgcggccggccgttatttcgccaccttcctctgcaccgacgtgccaaccaaggacatgcccgcgactgaccggaaggtcggaatcgacctcggcgtcaaaacgctcgcgactttctcggacggcacgaagatcggaaacccgcgccacctcaagaaatatgagcgcaagcttgcgcgggagcagcgtaggctctcccgcaggaagggcgcacgcaggggcgagaagcagtcgatgcggtacctgaagcagaggaaaagggtcgcccgggtccacgcgaagatcaccgatgccagaaccgatgcccttcacaaggtcacgaccatgctcgcggacgagaaccaagtcctgtgcatggaggacctgaatgccaagggcatggtgcgaaaccgtcgtctggcgaaagccgtgacggacgcctcgttcggcgagttcgcacggctgcttgagtacaagtgcgccgagcgtgggcgctcccttgtcaagatcggccgcttctacccgtcgagcaagacctgctcggcctgcgggcacaggctcgacgccctgccgctgtcggtacggtcatgggactgccccgcgtgcggtgcgcaccacgaccgcgacgtcaatgcggcgagaaacatactgacggaggggaaacgcatcctctccaacacggaaggtaccgcggggcacgcgggaaccgtggcggctgtagccgcctaaacgctcggggagaggacgtaagaccctagaggactatatcggtcctcgacggcagacctcgcagaactgagaatcccctggtttcaactacggggagtgtcaaaaggctcgtacatcaattgcgaggtgaccttgaccgtcaacgggaaaagcaagacatttgttcctaaggcaatttgcaacggcaaagtaagcgacggtatctacgtacgtcctagaatcggttaaaatcccagaggatccccgaggtatggagtttggaaaaacagtttgggtaaaagtcaattcctggaaacggctccttgacgcccaccaaaagaaaactgcatgcagccgccctcgtttcgggggcgctgcgcatctttttgaattgaatgaagacaggacacagccgatcgtcctcaccaggctatgggacagaaagacggttcacaaatgagggttccttttggacttgatgagcacggcaatgccgtatgggcagaccaaatcccctacgaccgcaacgggttcaagtgcggacttgtctgtcccgatccgaattgcgggaaacggctcaaggcagtccgatggtcgaaggacgacccggagagaggcatccactatttggcccacgaggcaaacagccggtgcgcggtcgagtcgaatccagagtcccttctccatctggaagcgaaagccgtcctcaaagggctcatcggccatgatttctacctccccaacctgtctctcatcgatagcgtcccgcatacgtcacgctatcggaacgccggcaaactcgaattcaagaagtatggcaaactgacagtccttcccgttcccggctcttctgtcctaaagttcagccccgaaacatacaaatcgttcattcccggtaccggttgcatgactaaaatcgaggatgtcaaaacagagcgcgattgcggcgcgatgtgccctgaaggtctcattccggatgcggtcgcactgctgtcgcatgccgatacggagatctgggtcgccatcgaattccgcgtcagccatccgaaagccatcgaggatgtgcggaaatatgccaccgtggatttcccggtcatggaaatatccatcacagatgatatcgcaaatgcgggggataccagaaagagcctggcagaacgaattacaggaaccggccatgcgacgcgtttcgccggtcgcgaatggctctactctcctgcagctaaaaagattctcaagcgtagctggcatatcgaggcagaaccatccgataaaccgctccgccataaaggaacagatctcgtaaggctggagacaccgcttccggcaatcacggtctatgccgtgaaaggcgcaccgacaggtgagacctcatgggacaacatcgacctcacactccgggagatctccgaagcgaccgtcgagaagcaagaagaggcactgaggaagaaaaggtcactcagttccagatgcccttcctataaaaacagcgcacccgccggccgacaaataaagcagaccgaagataccggttttgaaacgccgacgaaaccgcacgggattctcggaaggctaaaaggcctcttcgacaaatttcggaagtgaaattcgcaaacgtttgcgaatttggaaagtccacacgaaaacgggctgagaaatcgctattatggttaagagcacgagtttgatcccctttctcgtgcagggacatcttcttcccaccgatggatgtgcccgctccccaatctcgggcgcatccatcacccattttgcaaatataccaatatccgcgtagtcgtcatataccatcaacagtctcgatctcttcttatggacggggtcatttttttaatgcgaagtggtagaatcttacaaaagatattcaaagaaaggatttatgcaatggttccgaaagtagacccatcgaaatttccagaaatgctgaacgctattacggagaacgtccgagacagctatgcgggaatggtctttatcgacgatcctgaagatctggcctcatgggggttcactaaagaacaacttaatgaactggactcttttgcacaaaaatatggattgactgacgttctcgaaatcaatgaatggaatcccgattccaagccggactatatcctttcggcattttccggcctcgtggataagatcgacgatctgcagggacgaatccgaccaaaagccgatgatgtctcaattgaaaactttatctacctgaatcagatcaaggccgatgtccccgaaccggatcagtttgaccatgccgaagagaatgaccatatcttcggtttgatctctaaatttgccgaggaacaggacaccgccttcgtcgtgcaaaaggtcaatttctccggcacgaaacaaatcggtgaacccgaatatgagcttcttcctctcggtcccacttccggtgaggaccttgccgatttcaccgagtggtttatggacgatttcaagagcggtatcgactttggctgcgatgaaaaccgcgagcaccttgccatgctcgcccataccggattctatcgtgaaggcgagtatgtggaccagctgctcacctttcaccaacttgatttttccaatgcccatgccgtgacggaaaatttctcctttgaaggtcgcccggaaagcaatgagttcataggcgatctcgaccagctgttccatgatccaaattcactcgtcagctcgtcagacatcatcgatattatcgaaaacgaaccggtcggaggtgtttccaacggtgggaagccctgccgtgaacacacgaggctttccgataaagccgaaaccgccaaatctgcctgcagcaagatcgctgaatctgaacaacgtgagcggggaatcgagaagccgatccaaatcgaggcaaaatgatcagcgaacgcgacctcaggcttgcaaaggcaatcgtcgacccatatatcggacaggacattatcgctaccgccgtactcgggacgaagctcgggagcatgctgaacgagaacgcataccgtgaagtcgtcaacaatgcccaaaggcttatcgatggaaccgagtgtatcccgcagggcaagacgctcgagttcattttgagatagcgatacgtcgagacaatcaaggccgatcggaagagcgatctatccctttccaagatgcgcgggctgttgaagggcaatcgtgccgtagcgcgagacgattgcgagacgaataacgagaagacttacgaagagcgttaaatgcggcgccttcggcacctatgatccgctcgcaacgctcgctgatggattgttttctactctactaaggagggaatatgtggaaggaaaagcttcaggacacagcagcatcccatccatggcttgagccgcatgaagccatcaaacggaaaacccaagcaccgggaatgcaattggtagattggtacggcttcaccgtgccgaaaacaaaaaaggagatgtttctcaagcagtccgcccgtcgtgaagatctccttgttgtcggcgaggtcgacaacatccattcttttttcagcgactatgagacggaatggagatcgaatatcctattcgatgatctcgacgaggcgctgcgctactgcgaggacgtccgttccggtttcatctccgatatccagctgcattcgagtttcatcatgtacaaagagccgggatttaaagccatgccgggtggcggcttcgccggatggagcgatctattctatgcggctcacggcaacctggaatatgccaacaagctccttttcgattgccaagccggtgatcgcgacggcatggacccgcgccgatgcgcaagggaagacttgatcaacggagtcattgccgagttcggcagcgagtacatcatgaccggagatgccggccagaaaaatcgtctgaacagcgcggaaatcttgcgcttcgaactcgatagcgtcccgactgacgggaatgggcatatcaccgggtatttccacggtttccctctcggtacgagcctggaagatatcagtgcggcgatcgacaacgtaggcaaagtagaaaatggccatccgaacagaatcgatgtccccgaagaaccagaacgtatcgaaccagaacaaaacgtaggcgtttccaatgaaaagcctaccgtcaccgagatcgaagattcttccattcgagagcccaaaagccatcccacacaatcgggaaagccggtttggacgaaccttgaagttcctcccgacaatgtaaggctcctcacaggtgtctcaaggaagacggacaggccatggtatcgtgccgattgcactctcggagaggaatcttcaatcaagccaggtggcaaatttaaaatcctgctgagtgagaggcagtacgcacgcgccgatgctcaaaaaaaggccggtaaaccggtcagtctcggcttgaaaaccgccaggtatccagatggagtcgaaatcgacggcgagatggtcgcacttgaagaccttgccgccgatatcaatgtccgaaaaaccaacccactgcccaaaagtcctgaggagtatcgcggtgccacggaacaatcctttgacgagaacgaatgggtgaattttcgcttcttcccggacctggtcgacctttcaaaatccatcgactcagacacggcgagaacggattatcgtgccgatgtgacgtccgaagtcgccgggcgaaactgctcatttaccctgcatcttgcaaaatggcagtacgataaggccgtcaaggaccaaaaccagaactcccctatccatatcgggatgaagcttaaatatataaagggcggcgtaatcccagtccagttcgaaggtgaacagtccacccataactattctccaaagaaactcgaagaaagcctgccgaaggtgcagaaagcacgttccgtcagcgggtgtaggcagggaaaaggaaaccgggtatcctcctatcaagaccgatcctatcgtttcaaaacgaaggaagcatatgaacatggacttccaggagcacacgaaagcaggaactaaacatgaacgaaaactcaaccatatcgaacgcttatgatggcaagcatgatgaatacggtcatgatctacccaggtggatgaatttcgagcatgtcatcgatattggtgaggcggacccgactcaaacggcaaccgactattacggctttgaacttcccaatggcgtcgcaatggtcatccagagccaaccaagccatagggatcatcctttcatcgtctacagttacggcgatggagcctgtttccatgacgatgtcgaattcgattcgctccgcacagcgattagctatgcatcccagctccacagcggagcaatcgatccagattacctgcgcgtcgaatatacgcatgatgaatatgaaacactttgctggcgcgatttctaccaggcggcacacggtaatatcgaatacgcctcacgtctcgtcgaccagtgcaacggcggatttcgagaagggttcggcccgtatgcctgcgcagccgaagacctcgctgaaggcgaaatcgtcaatttcaacaactgctacgtcatcacggatgcgaacggaccggatacaaaggaaatcgccgcaaaaaggatttgggatgaactcggagatgtctgcatagacgataatgaatgtatcgattcggaattctacggctaccctatcgggacatttcgggaagacatctggcatgacatcgaggaccagcttgaagtcccgatccatgaactgatgtttcccgatgatgtaaacaaggacatgactaatgaaaggagtcttactatgtccaacgagaataagaacaccaatgtcaaggaagagacgacctggacgaacttcaagttcttcaacaaccaggtcaaactcaaggtcatcgagaaggacgaccgtcagatgtatctggcagattgccgcttcatgccgggttctgtcgcaaacggcatcgatctcggcgatcagaacggcatctccggccatatgaccgtgttcctcaccgagaagcagtatttcaaggctgctgagcagaaagctaacggtgagcagatcaatgtcggacttccgagcactcagctcaaggacggtaagatcgaggtcaatttctacaaccacgaatctaaggaagcacgcaccattcccgtaaatcccttcgccgcgtccaaggcgaacaaggccgcccgcgatgctttcttcgagcgcaaggatgccgagcgcgagcagggcaagagtctcggcgcaaagaccgcatccgcccgcggcgcgtccgaaaagctggacggtcaaagccaggccacgcccgctaaggacaatcttgagcattaggttgtcatcgatttagtgcaatcagacatgcggtctgtcgttccattcggatggcagaccgctttttgtgcggcgtgcaagcacgcctatgatccactcgtcatgctcgctgatttataatgatttacgctatggaagaaaggaaagtgacctatgaaacttataacctattatcagaccggcaagatcgatgtgttcgacaccgccaccttcacggcgaccgatcccttcaagagggacggtatgaacctgatcacggaattcgcaatccgcttcgacctgcttgaagacaagaactcgaatgagggccttgtcgtcgacgtctattggtacgatgcgaagatccatgacaaggacaatgccgtgacatcgctcgacgagaagaagaacgccacgctcaacaatgcactcctcaaggcgagtacccgcatccgcctgatttccaagagggaactcgaggacgtggcgaaaatcacccttgacggcgaacttgtcgaatggcgccagggcggcgagctcgtcaacggcgtcaagttcttcagccaagagctgctgtatttcagcaacggacgcagcgcgtcaatcacggagcgtgcctgcaagatcagccaattcatcaagaatgccaatccggagctgcccgatgagatcattgccggctggatgggcctgcctccgaccgtccttgagaccatgaaacgcgaccaattgcgcaacgatcaggtcagcgagcaagacgactaggcacacctctcctgtagaagagtgctataatttattctacgttccttccctatccagaacgttttgcagcacagggaataggcggcttgcgcggtttcgcgtaggccgcctattcctttctgtatgatctttgaatttctggttgactttcttttctaataccaaagtgctataatataagtgtatagaactagacttaattgtattggaggaattcaaatggaatggcttttactttttatactcggtccgccgattctcactctgatcttaaggatcttgatcttcatcgttcggtacggtccgggcttcgtcggtgcgatcttcgatttgatctgctgtgtgctcgggctcgtcggctgcatcatcatgctcatcatccgtgggatcatggcagtcttccacggcctcaaggtgcttttcttcgggcactcctcaccgccccggaacgctcatgtcgattcgtctgtctcacctgatgacatcgaaaagttcatcaaggcgttcgaaaataagatgtaatcagaagaccaggattaaaggaatggtgtctaatggttgaatccgaaaccgttttttagaaactacaggccgcatgcatcagcggagtgaaagttccacatctgatgtcgctgcctgttgtttcgcatctgaacggtaaatacgatctgtcaatcacctgtatcaagaacaaacttgatccgattcttgctgaaaaactttaaggcttgttttcgtgtacctattgggttgtgcggctgacaaaaagtccatccgggtaacgtatgtcatatgtatcccgaacctgtttcatcaactcgtctctcgtgcagcaattcgcctgacagctttcaacgatttggtagcgcaaccaccggcgttctgtgctcgcatcagagccgcggtgttcaatgatcttaatcttgaccatcaaatttagcagtcggtcaagatcactttcctttatcgtcgtcactactctctctttcctctaaattcgcaagcgcttgcgaatcaccctgtcgatacccctaaaagtacacaattagaaaagagttacggcaattctttgcatatctcttatccagatcgtgtttgtttgcgagatcggtaaatttcttctctttttcattccgatctgtaatgggtctggcattctgtacagacattttttcaccgctgcggaatttggtttatcgcaaataccccctcacattacatggtgtaacccgcgcagcggaatcctttgacaaagccccggttgtctaccggggcttctttctgtctattacgattgctctttccgcttgtacgccgccagctcgcgctcgacctgcctgtcgccggtctcgttgacccaccagggccatttcacccggtcgcacggctcgtcgactccggcgaaccattccctcagctcgtcgaggctcaccggggagtgcccgttggcatcgcaaccgacgtcgtagcgcagaaggccctgcttgcggttgaactcgttgtacgcgccgccgccgctgtggatgtgtccgtggaggtgccacgatccatggcccataccctgccagtcggccatggggtaatggctcaggacgatcttctgcccgtcgatcttgagcacgcagatcggcggctccacggtgaaggcgccagcgaccgccggctgggtccagtccttgtcgtggtttcccgggacgaggtggatgcgcctgcaggcgatccgcttgcgcagggcataggcgtcctgggcggtcatcttgaatgagaaatcccccaggatgtagagctcgtcgtccacggcaaccctgccgttgatgctgtcgacgatggcatcgttcatctgccaaatcgtctcccacgggcggtcggtgaacttcagcacgttctcatgcccgaaatgggtatcgctagtaaaccagatcatatttccctacctcccttttgcattatgtatgatttacaaaatcaatcataccacggtactaccatataatgcaatcaaacccagatctcatttcagcctgtataggcaataccgggaagtacttacaatcttctcgcttcccctaacttctttttcaaatagtcgctgctcatcctttcgaatgatagccacatcccaatatccgtcatcaagcgtcttgaagctttttgcattcacgacatcgacatagcgcttgtaatcatcatgggtacgctcgccggcaattgccttagcccagatttcgggtcgcatatcgtagcttacctttatgtcttcccactcaaaataattcatcaaggtatcgtcgctggagaaaatgcgtgcatccgtaccctttagtgcgtcgacaatcggtgccgtttcttgatcgaatgccgaccacccagacgccgtcgtgccatccaaagaactggccgcttccgaggcgtttaaaaccgaggtcgccaacagcactcctataaacaggacgggcatcagccgtatcgcgctgccctcttcctcgcgttcgatgccggttctgccaatgccgcacagataggcgcaaacaacaaaagaaaccgtccaggcaatccaaaaacaccggattttcagaacgcccatcaccatcgccgcaatccaaaatgcaagcacgccggtgttcggaacctttcctttaatgattgcgatggcaacgggaatgacgatacacaccatcgtgcagacgatgccataggaatcattcggacttgagataaatggacgcatctcgctaatgacattgccgtaggacgcggctcccatagagagcactgtgtagatcgccccgccgaatccgtagggattgaaaagtgaggctatgcacatcaagagacacgccctcaatagaggaattcgataggtgtaccaggcgaccatgtcggtcttaaacgtcttgatatgcagttcccctatttccggtaaaaggaaagacaggcacgccgccaaacataggggccacatcgccgcctgaagattcacctgaagcaaggtgactgccggaagaagccaaagtgcccgaacgttaccgtcctcgtgccatgcaaagaggatattcaacgtcacgaacaggcaaccggcagaccacaaggtaggccgtatcgagatgtaggtaaacatataaaagaaaccgaccgcatacagcagccaagtgatcccttggtgtcggcaacctctcgtcagcctttcaattaaaaaataataggcgatggccgctatcgccagcggaaccaccaccgatgtggcgacgccggtatagcccgcaagggaataccagccataaagccatacatcgtgcagccattgctggacaataatgccctgcccggaatccagtgaccacgggttctcgaagggaatcccgttgtgcacaatctcacgtcccgttgccaaaaggaaccagccgtccgtgtccaacgtcccgtctatacggatatatcccgtaaaccacgcaacaaaaatcgataccattgccgcagtgatgtacgaaagcatgcgcaacgggcgtatgctatccccgctgtccgatttctcggtatgcactcggtccaacaccatatacctctccacctctcgccaagcaaaacgggctccttgaaagaagcccgtcatttcaaccatttgcctactgggcacccgtactgccgaacccgcctgtcccgcgatcgctttcaggaagttcgtcaacctggacaaacgttgcatggacgcatgggataatgagcaattgagcgatacggtccccggggttgatcgtgtaggggcgccttccgatgttcaccaacttcgcctttacgggaccccgatagcacgaatcgataattccaagagagttcgcaagcatcagaccatgcttgcaggcaaggctggagcggatcgccaacgcaccgaaatagccctcaggaatggcgacctcgattccggtattgaaaaaggtcgattcgcgcggctggagcgtcaccggctccggaatatcggcgcgtagatcggcgccagcgtccgtcgggtgaacacggacgggcagaaacccctcttttgcgacagtctcgatttgcattgaaatacctttccctaaaactgattccacgtggattgatagtccctgccgggtgcgtcttcgcgctcccatggaagagcctcctcgacagctgagttgacgggcgcggcctgcttttcggcagccttctccttctccagaaggtcggcgatataggccttgacctgctcgctgaaccgctgtgggcactccagttggactgtgccctcactcgccttcttctccatacgcgcatagaagtcaatgacttcgcgactcgcatggagtcggttcttctccatcttcgggaagatggtaagcccctcgatgttggagcaacgggacagaccgacgtagagttgcccggcggcgaaggtcttcgtgtggacggtgcagcgatcgaaggtaagaccctgggacttatggatggtgatggcgtaggcaagcttgaggggaatttgcgtgaactcacctaccgtgtcagaagtcactttgtttttcgttttgcccttcgggtcgacgaactcctcgacaaccgatttgaggatcttccacgtgtgagcctcaatcttcaccggctcgtcaggattggcatcaaaggcgaccgtcacgctcgtcttggtgcatttcacgaccgtgccctgcgagccgttgacatatttaccctcggggtcgttgacgagcgacatgacgcgggcaccggcgcatagggtgatcttatcgtcggccgcgcgatctcccttgttcacctttcccgtcgcgctggcctgataggtgtatttcttcccgctcagctccgacacgctctccgtattgatattcgatgcaagcctgttgttcgagcataggaacagggcatccttgggcgcgtatttgcgatccgatacggaatgctcgttgaaatacgggatgcatgactcatcgccgttacgcgcgagattcaggttcccgatgtactccggatcgtcctggcgcacgaccttcttcaggatgtgcggctcgaagtcgaatccgtcccagtaatcggattcaaacgcccaaccctcgaaattgccggggtacagcttcatgaggatcgcacggtcatcttccgtgatgaccgggggaagctggaagaaatcaccgacgagcacgacctgctttcgaccggacgagacctgcgcatcagagatcatgcgcatgacgtaatcgaaaaggtcgatgcggcacatcgagatctcatcgatgatgatgacctccgcgaccgtcaggaccttgcggggacgaatcttctcgaacgggttgcatacgccggcgctcacctgcagagtacggtggatggtcgagccattgtgcatgttgagcgccgcgatacccgtcggcgccatcgccgtgtagggaacgctacgggcctcaaggtcatcgatgaaccggttgagcacatagctcttgcccgtgccggcgttaccggaaaggaagacgttacgcccctccttcagggcaatgtaggcgtcccgctggtcttcggtcagaccctccagctcagtctcatcgattaccatttcactttcacttccccactggcgatctgcgcatacgtcacggtgatgcgatgctgcttgttcctacgtgtcggcaacgtcgaacaaaccaggaaattactgctcgccgactcaaagcagacatcaacctcaaccttatcgagaccttcagccttctggcggcgcgtcggaggaagaaggaccttccccttctttcccgtgtgggccatcgccgccgcacggatcctctcacggcccttgctgccgtaggtctcctgctcatactcgaacatcggtatcactttccccttttgtacgtcggtctttttgatgtagtaggattataccacaataccatactgtttgtacttaaaaaagccctgcgtcggcaccgggacgtcgataaccagaacgaaagcctcgtttgtctgtgtgccagaaaaagcgaagttcaagctctgaatggcggtttagcctatgagttgaaagaacccataggtcctcattttcgatattttattgcctgcttcgcgcttctgcggaaaagggaaaatcgtcaccacagattaccgtcaatcgtcccaatgaatcatcgtcaattgtcccaacgacgcaggtaaaccatatgattttaagggcgctgcggaagctgggaaatggacggtcaagacgcaaaccgtggctggcaagacgaaaaaagggaatcccttttgcgggattcccctttccgagtcgttatgcgatttgcactacatctgctcgcggcgcttcttttgatcgaggaagacgccggctgccacgaggacggtaccgccgatgacgaacgtctcgccgatgagtcccgcgcggtcaccggtctgggcgaggttgccgggctgggcggtatccgtgccggcgaggtgcttcggggtgtatgccgcctgctgctttgccgcctcctctgcctcctgtcgtgcgatctcatcggaaagcttctgctccgctgcgatgcggtcggacttcgcctgctcgtaggcggcgagtgccgcatcatagccggactggagcccgtccaccgcggcctgcttctcgtccaggatggccttggcaggagcgaccttggcacgtgcctcgactgctgcggcgaaaagcgcgttgagggcgtcatccgcgttcacatcatggccggaagcgatcgccgcgccggcatcgatggagttcagcttcgacagcttggcgtctgcctgcgcctttgcctgctcggcggcggagaccagggactcggcggcgatggcatccgccttcgcggcatcgagcgcggccttggtgtcattgacggcctttactgcatcctgctcgcgctgctgtgtctctgcgagcttcgcggcaagaccggtgaggatgtcgaggttcgactgtgcgcccacaagatcggtctgggagccggtgagcctgtcggcggcaacgccggtgtcggcctttgcggcatcgacggcacgctgggcatccgcgagggcgcgtgcggtgccgttcgccttttgcttggcggctgcgaggactgccgccttctcggcctggtcggctgccgccgcgtcatggacgctctttgcggtatcgaccgccttcttggcgtcggcgacgtcctggaagaacttcgcgaggtcggcgttcgcatcgtctacgccctgctgcttagcagcggtgtccgccttggcggaatccaacttagactgtgcggtcattacggctgcgttggcagcatcaaaggcgacctgcttctgctggacggtcgactttgccgtatcgactgccgcgttggcggcatcgaggtccgatttcgccgcatcaagctcggtctgggcatccgtgacgccctgctgcttggcggcgacatcagccttggtggcatcgacggcacgctgggcatcggcaacaccctgctttgcggcatcgacacctgcctgtgcggaatccaccgcgacctgcttctgctggacggttgtggcggcgccggcggctgcctgcttcttggatgcgagatcggccttggctacgtcgagtgcgctcttggcgctcttcaggccgttgatgtaggaggtcagattctgctcgtactcgtcgacggacatgggattcatgttccagcctgaacctgcccaaccaaggtttgcggtatcgaggctgtcggtctgccagccgttcaaggttcccttgctgcagactgccatgcccatatagccgatttcggggctgatgacatgcaggtagtgaccgacggttgcgggatatccggcaaccttgaagtgctggttgacataggattcaatcccgctatgcgtcttgtagaaatctacggcatccttaccggttagaccggtgacgccatagagctcctgaaccgcctgatcgaagaaagccttttcttggtcaacccactgcggtttcggatcggttccataattccatgcgaggttttcggtcgtatcgaactgcatggaatgtccaaacttgacatcggaatagtttgcgttggctatcgccgctgcaatgagcttataggtgacctggagttcggagagaccgacggacttgcgatactcgttgatggacttcatgtacgggattgccgcgagcatgttgtcgagactggtcgcatcgaggctgtttccgacctcggtgtagtccttgtgtgtacagttctggatgatctcgatggctgaatcggcacccatggccttgaagaagccgatggctccctgcttgagctgcgcatcggcggagtcgagtttcgcctgtgcctcgtcgaccttctgctgggcggcggtcacggccgcgtcagcggtatcctttgcggtcttggcgttcgtaagctctacgtcggcggctgccttggcggactcggcgtccttgacagcctgcttcgcggcatccagcttggcgatggcatcggcgttcgcctgcttggccgcatcgaggtcggagttcgcggcatcgagtgcggactgggcgtcgttcacgccggacgcggcatcgaccgcggcctgctgctttacggagagagccgcctgggcatcatttagctcggtctgtgccgttgccgcggcggactgcacctgctcgagctcggactcgcactgggactgtgccgcttgtgcggcggcgagggttgcctccgcgtccgcgaccttctgttttgccgcatcgtactccggaccgctggcgcctgcctccgctgcggcgaggtctgctttcgccttctcgtaggcggcgctggcggctgcggccttcgcatccgccgcgtccttgttctgctgggctgcggcgaggacggcgtcggcggaatcctttgcagactgggccgcaaccagcttggactgggcatcggcaagcgtcgcgttggcgttggcgaggccggcctgtgccctttccacggcagcctgggcgtcgcgcacggcctgttcggcggcactgattgcctccggggtggcgcttacggcatctgccttggccttatcgagggcgtccttggcatcctgggccgccttgagggcggactggtacgcttcgtccttctcggacgcatcggccttggcgtctgcgagacctgccttcgcctgctcgaggtccttgccggcggcatcggcggcgtccttgccctccgcgacctgacgggcgtactcgtccattgccgctcggtcggctgccgtgccggcgctgactgccgaatcgtaggatgccttggcctggtcgcgggcggaagccgcctcgttgtagggaccggcggcctcatcgtaggctgccttggcggcgtcctccttcgccttcgcctcgttgactgccttctgcaggtccgcgatggtctgtgcggcggatttcgcgccggtaccggatgccgcgccggcgtgggcggcgatcggcgacatcacggcggggtgctgtgtgcccccgtcaccggtctgggcgaatgccgtgaacggtgagatgaggctcgatccggtcatggcggccatggtcgccgcggtgacggtcagacgtgcgatccccttcggggcgtgaaactttttgcttggcagtgcgtgtttcttctcgtacatgaatctttcgtcctttctgtgaaacgtgctgtcaactatagcggatgacagccaatttcgtttagtaacgccctgttttcttgacgtgtatcagtataccacgatactagagtactacctctgagaatcttctgaaatttcgtctgcccagtaccaatgatgccccttcgccttgcgtcctgtggtaatcgcccgtttgatcccactccccgcatatccgtatgcagacatactcgccgcggcgatactgtcgaagatcttcccgtcatcgcgacggacccgtttcttaccgcctccaagccctgcgtagatgtcgatatcgctcatggacgttccttccaatagctgcatgtattgccatgtccggtttcaaaggcatgtccctctccacgcctgacgcacagatattgaacctggatgtcctccagtctatgacgcttgtcgcgaacatggggattctgaatgcagtgtgcacacaggctgcagacccttttctctcgtgcctgttctttctgaaatcctcggtctgatacgcgaagatcgttatcggaaaccatagctcatcctttcattggcaagtcgagttcggatcgtacatagcaaaacgattggggcggccgtttcagttcaggattcaaggtttgcagctcaagcgaatccttgaacggaacaactgaatagatacggatggcaacggccttatcgcacccctcgtaatatccaaagaacctgtcagccgtcaagccgctatgggtcttcgaatacgtccacacggcctccggagacgcctgtagtatcgaccaatcggcgataatgcccgtcaccttctggaccggtgccgtctcatacaggagaatcggcaaatcaaccagttttggagccctctttcgatattcgaagcgcttcctttctgtatatatcagatcggcataatgcggcttgatcgacattaggatatattctctcgaaagcccatttaagcccattcgttcctccttttttgcatttgctgatacgatgataccacaatacaacggtgctacttactaggacagaaaaatgacccggctccttatcggacaccgagtcacacaactgctcttcaaatcatcttattttaagagaaatgcagggaacgaccttctcattttttctgccctaaatatctaaaccaaatcctttgtcagtaaaaaccatatatgtggacaaatctcgtcttgatccacccagagcacttccctatttgatatcgagacaggtgcacggaacgattacgtatgcgtcttgatggtccaaaaccttgatgtggtcgcgggaggaatcgataacgtccgcatgggcgatatcgggcggcaggcgaaataaatcctcgcagtcgatataggccacgcacctctcataaccgccctcacggataatcacgagttcgtgtaccttggtctcgtgacggcaatactcgataacggtcatctatacatccttccgaagatttcgcccgcaaatggggcaatagttgatagggatccatgcgcggtcgatatcgttgtcgtgggacatcttcaggtgcgccccatgtccatcaatcgtctcgagcgacagctccaccccgtcaatcaggttcatatcgccacagacggtatcgatatcgttgagagcctttcggcggtatggggtacaccacgggcaatagcggtcgttggcgccctcgcgcgatgtacgccaggagccggcactatggcagaccatccggtacagcagctcggaggcgggtgcgatacggctgctgcccgcgccgatactgagatcgaatttcttcaataagcgacccctgccgtcttggcagaataccgccgcgctttttggtagttggcgggtctcgtagagcgactgcgcgagatctggagggcagacgagccaattcgcatcgccctggaaggtcagaccgtgtccgctcttgaaatcggccatgcacgatttgacctcgacgtagacgaattcaccgcgctcgatcgatgacgggaacggtgaaaaccgctcgggcctgaagcccacgaaatcgacgcgatggtcatcgtctacccagacctcggacgcaaccaaggaatactcacggcgcagacgagccaagacgcgctcggacagttcgcctgtcgtctcatcacgctgtcccaattcatgcctcccgattctgatgggttccggtaaagtcggctatctgtccgacttcctacggagatccttctcgatttcgttgtgctgcttcagcatgtcaaccatgtcgcacatgatttcgattaagccagcttcgctaatgctcatgaatcaattcctttcccttttctctaaatcgggtgttccaggtcttaagggcggcaatgcaggcattgtactcatcctctccttcgataatcgacccacgcttcggaccgtcaatctcggcaccgcagttcagacatctgcacgtcgcatctgagtagtaaacggttcgaacattttcctcgtaagaagaaacaccgcaattatgggggtagattgtcacctcgaccccgccgcagaacgggtagggtttcgcatcactgacatccatataggaaatattctgacagccgatgaagtgcgtgcgctccaccttgtatttacgcgtcatcctgactcctttggcttcaaaatcatcaactctttattgcaataccatcataccacagtaggaagatactacagacgagaaaacttgatggatccgaattcttcaaagtctagattctggtcttacgacattaaaaaagccctacggcacacgaaacgtgccgcagggctttggattatgaaacagaaccgattctgtcaaacgggaaatagcgtgcgaatacgataccgatcacgctatcctcctccaccggtccgaaatagcgtgaatctgccgaattctcacggttgtctcccattacccaaatgcatccgtcggggattgtataaggataggaatcgggtgctaatgacagatgtgcatccagtggcttgctttcccccatcgcataggattcatccaggcgcctgccatcgacataaaccttgccgtctttcaggtcgacagtctgaccggacgtcgcgatgacacgtttgacaaggatgtcaactccgttcctcggcctcggattcttgaatacgacgatgtcgcctggcttcaaatcacttcccgtctcaagggtaatcttctgcgcaagtatgcagtcacccacctcaatcgtcgattccatcgatcccgtcggcacgacaaacggttcgatcacaaacgcccgcaagaggaagaccgccgccacgacagcgccgatgaacgttatgaatttcagaatatttttcaggattgaagtaataccggtcgtcatgcatttcgcctttctgttaggatagcaccatcataccacagtaccgaattttggactcggaatgccatcccctctcccattaccacgaacttccccatcaaactgcaaacaactctggaaaagacggaaagattgacgagtttcttgaggtcttcgcgattcagttaagcccaatcagttgatttcatcttcgaaatcccggcttgaagatattctccaagcggaatcttatcgaggctgttgatctcaatctcaggagaaagccaaccgctgtcttcaaggtcattacgggcaatttgatatgaatcgtagtcgccacgtccgagatacatcactgcctgtgcgtccttgatggcgtcgaacccccaagagtacagacgatccctaatcggacgaaaatatgtgaatggaagctcatctgggtttctatagacctgcatcgccaggtctgcaagatcctgtaaatctttgcgactaatcgaacatgcgaattcctgcatctgctttcctttctttgcagttaccttcctaccgtttagcctttagaggccgccccggtcagatagtcgagggcatatccgggctgtacgttatagcaatagacatcgaatgaaagttcatcatcctgactgtctactgactgcgcctggatgcgaacgccgcgagccatcagctcgttgtcgcggaaatcaggggccaccttgtagagaacgctattccccgtgcgctcgatgtagctcgcgacctgcgtctcatagggcaacatgccctctacgttcatatatctcgtaccggtgatcagattccgctcctccgcattcataccggaaaggcaccacgcgatgaggtggcatctgttataaaggtatttgccgtcaaggctgtcatcgcgcaccgtatgccaaccggaaggtttcaccatcccgatacttccccgtcgctcaccctccgcgggcatcgtgtccggcgttacgaccatctcgacggtaccgcaccgtccaagactgtccagctctgaaagcacagtctccgaaggaagatcggatatgtctagacctgatccatctgaaaggacaactgacgcaagcccggtgtaatccggaatacttgatgtcgaagtggtttttgactgcggagaagacgttccatccggcacctgaatcggatgaacgttaagattcagcccgattccatttatgcaagtgattgccaatactacggcaaggacgactttgatgtttctggaagatataagttgtttcatacaactccccgttgcttaaaattgcctaaagaaacaatggagttgagattctgcctcgcaagctgcagccctaccgattgatcggcgcagaagcgacgatctcacgaagacggttggcaatccagctcttcttaccggtgtattccctgccgttgatatggacgatattcgaactactttcaagctcgcgggcgatagaaagaagatcctcggcatcgatcacgatcttctctcctaccgcttttttctttgggctgtccatttgaactttctcgttctcagcctggcccaggcgaaacggattgaaaaacatcttattctccaaagtgacgaccatgcggaccggccttctcgaacatagacaaagtcggcgcgtaatatattcgacccatatgtggaaacataaccgctatcggttcttcggttccagcgcggcacaggacgtaatcacgccagctgtccgggtaggcagccttgatgtagtcgacaatcccgtcgattttaggcctatccatgtgcctcactccttcgccgcctgaattcaaaaaagaaaaggcagacagacaaaaacagaagcgagatgctggagatctctaatttcatccacatcggcataacgaaaactgcccttaagacacccaagtagatgctaaacatcgcatccaacaaataaactgcaatagccatatctatccgatcggaaaacgatggttcagcatgacatccttgctgaactcacgtgaggatttgactgtgaccgtatcgccgggctccggcatcgtctcagacacgaatgcgatcgtatcgcgatatagcaaaaccgccctttctcccggagccgtatagaaccgaagcaggacatccgccttgcgctcgtcctcggaatcgattgccaggatatatgcggagacgagatcgccggacggagcctcaataaaactatgaaaagccttgccaaaggcaccgagtctgccggttcgggaagaaagaaatgctttcctgcagtcctcctcgacatcaaggagtttgctttcattcagaaacggctccggaaccgcgggatgattgtttttaatctcgcgaatcatatcgatattgagcttgctcatttaatctcccatctcagtggatgctgcggaatcgaaaccaaatggatcaatcaggtccgcgatatccgttagatatctcttggcatagaccgccatgacatcatcaccgtaaaccgcttccataagcagggaatccacggtgtccggggtcgctattttcgctttcccacgaagccggcttgcaattttgcggcgcagctcatccgtgatttcctcaccattgatcgtgctgtttttcatccttgtttccctttcctttaggcggtactattgtagcataggattacgaaacgagacgtatgacggggagaatttctggacgatttagcgaaatgccatctgtgcggcgtgcaagcacgcctatgatccgctcacttcgttcgctcgattgattttcgcaagcgcttgcgatgtgcatgaaaggcaggcaaaaatggaaccgttcgatcttaacgcgatcgaggtgaatgtcgagattgatcaaagcgattcgcctgtacatatcatctggaatgatgggcgtgttttcgacatcgtcagctacggtgccgtcgtaccgtgtccctcgaaaaccggacccgaacttgcgaccgtacgggatgttttcatcgctgtcggacatggaaaaacgactagacgctcactcatctgtgacaacgggatatggtctatcgtgtcggtcaaaaaatgaagatggatatgagcgccttaaaagtgactctcatatccatctaatattcctcgctggggcgcggaaagagcatggcttgatgtttgtagctcgtttggttgtgccatgccgtatatattagtatagcatagtggtatcacgatactaatttgcatcatacggagagcatattttcggctcgccatcccaaacatatttgacccattgatcatatcttccgttcgcaacaaagccagcttcgatggctgaaaaccaatattttttctcgcgggttctgttcctatctataaaaagctcgacaagcctcacatactgattatcaggccagacgatactttgattgtaaggtgttgtctccccgatataagttaatcttccttgtttgaagtattccggatctctaagcaacgcataccaagcactatcagaaaaaacatagtttttcaaatcaaatgaaggagaggccccatatcccaatttcctcaatttgattttgtaatcatctaagaactccaccttgctgtagacgcttttatattcgctataccattctttcggcttcgtttgaccaaccttttgcatgtgaatataggttggcggcaatttcttaccatccaagttgggtttctcttcttcggcatcttcaaaaaacaattcacaggtattgaaatactcgtccattgtcagttcactcggcgtgtaattcataccaggttcgccttccggtccatatctaactaccggaaaagatgcccatgtgttcaccggttcgtctttaggtgttacatatggtgcatcgtctgcaaagaaattataattctcgcctgccacttcaaccgtatcgataactctgagcggcagataacttattccaccatcataagaaataagcgacggaaaaagctccggcaaagtaaggctaaagcaatttaatatcttaacggtatccgtatgtgttatcttgcgaagcccatgctcatattccaataacacctgttcctggatattcagcttgcaggccgcttcaaaccgggtaaccagaaggtgatttttacgatacaaatacaatgtattgaataaaatctcaccattgccataccaaatgaaggcgccgcttccattgaactcctctagagactctttacgtctgcaacttcgctcgattccatattccgacagcaccttatcgataatcttcataggcacctgcctgtcgcctgacatatatcgattcatcgcccgtctggaacagttaaatatcttcgataatcttgtaacggagctacctgtatccttactgtagattatcaacagttttctgtattccttattttctgctgcgtgctgtgcagcggttttatttcttaattcttcacccaattcattttacctcttatgtgtaatatcatgataccagtatattaaatagctctgttccttacaactgcgccgcaatttttttctgagtcacagtaaaaaaggcaccctgcatttttttgcaggatgccttgactaaatcattgcgaaatcgcgtttaaattacgattggctgctgtcatcacgaggctgaaatggatgatggaacgagctaagcagctcggtaagatcgatgccagttgcatccttgagaccgctggtcacctgatcgaccatgccggtcgtgtcacggacgagcttcgtggcgttaccatcgccatacatcttaatggagtcgacagacgcaagcggtttggcgactgcctcggcaacctccggcataacatcgatgtagcgattggcgagaaggtaggcgttctccataccattgtatgcttccgtctgggccttgatgccggcggcgacaccctcgccatgtgccttctcagcggcgccgtcggcctcgcccttaaggcgcgtcgcctctgcctcagcctttgccttggccgagacgccttcagctgtcttctgggcactgtagagatcggcgtcagacttattctgtgcctcgaccttggcagcctcggcattcttggtgcgtgtgtagagctcggcatccgctttctgctctgcagcatagcggtcagcttcggcctgcttgcggaccgtggcatccagctcgcgctccttcacggcaacctgtcgctcggcgagttcgaccttcttggtctcggctgcgatctgcgcctcctgctgtgcgacataaagctcacgctgcttttcggccgtcacggtctgcttgaccatatctgcctcggctgcggccttgtcggcggtcttcttcagctccgccttcttcaaatcaagctggttctggcgctcggcgacctcctgctccgccctgatctgggcgagctccgcttccttcttgatctcagctgcctggtcggcgcccatcgagcggataatcccctgcgaatcggagaaatcctggacgttgaacgtgcggagctcaagaccgagattcgcaagatcgtcacgcgaaccctcgaataccttatggttaaaggactcacggtcacgcatgagctccttcaggtccatctgaccgataacctcacgcatctttccgagcatcacctcggtgacctgacgggtcatctcctccttgttcatattcaaatagttcttggaagcaatctcaatcagctcgggcgtctggccgatctgaaaattcgccacggcgcaagcatgaatcagaatcgcgtcctgggtcggaatgtcattctcggtcgtgagctgaacttgaactgcgccgagcgccaacgtgtccacacgctgcagtccggggataacgaatgtgccctttccggacacgctgcgcgtctgcccgaatccagatacaatcatcagtttgtccggcgggcacttcctccaacaggactcgaacacgacgatcaccatgatcacgattagaagcggtccgagcagaggaccaaacaaatcaaaaagcatctttttccctttctgttgatgctttggtaaaccggaccattataccataataccgaaatatggcgctgaaaaaaggtcacccaaacggatgacctttgcaaacggtcgcgtttcgccatcgtcacttaaggaatggtgaaccgcatatatatagttacatgcggactcaaaaacttcagggactttcaaaagcaagcggaacgttgaccttttcgttgttctttctgcattacgacttggtttacggtgcctccgaaacgaatggaacgcactgcgcttatctgtaattggtgagctactgtttggtttgcggtaccaccgaaactaaatatacgttcgatggcagaggtaaatgggtgaactgctacttggattacggtaccgccgaaaccctcgacccagcacgatcttgtgaaggcccggtgaactattgcttggattacggtatctacgaaactgaacaggctttttatcaaagaattcaaagggtgaactactgcttgggttacggcaactccgaaacaaaaggtagcccttagctcgaataacgtgaggtgaactactgcttggtttgcggtacttccgaaacgcttaaaggacccaagccgccaagctaatgggtgaactactacttagtctacggtatttccgaaacgcgtagcgctcggacgaaacgcctttctgcggcgaactactacttggattactatacgtccgaaataccggcaccgacggacgcattacctgcaagggtgaactattgcttgatttacgatgcctccgaaacagccgctgatggtgttgaagatgttcgcctggtgaactattacttgggttacggcaactccgaaaccaaagctcgctgcgtggtcagcatgccgtgaggtgaactactacctggattaccgtacctccgaaaccgatgtactcctaaagtgccaggatcacgtgatgggctactacctggattaccgtatctccgaaacacagaggttagaaagattgacatttcttcgggtgaactattgtttgggttacggtattttcgaaactaagtgctcctctagctgggcaaagcccgtggtgagctactgtttggtttgcggtacttccgaaacaaggcccagaagctcgccaaggccggcaagggtgaactactacctgggctacggtacatccgaaacgcacgcctacgtcactgctcgcgacattgcggtgaactactgcttggtttgcggtacttccgaaacagaggcagagtaacctggattcttttcttggtgagctacttcttgatttacggtagttcagaaacctcgagctaactgtagtttcgcttggttttggtgaactactacctggattacggtacctccgaaacaaagcccagaagctcgccaaggccggcaagggtgaactactatttggattacggtatttccgaaactaagcacttggggggccggtttttatgactgatgaactactgtttgatttacggtacctccgaaaccgacgacggatatcctcgaccgcgtgtcctggtgaactactacttggtttgcggtacttccgaaacgggaaagcatttcgctgccggtggcgatcaggtgaactactgcttggtttgcggtacttccgaaactgagcactagttttgtgcccattaaatcaggtcttaactaattacaaataaaagaaattcctgttctcaacaggaaaaatggtgaatatcgccatgcaattcaagctgaataaaatctctcaaataccagccgagattttcaaaaaaatcggtaaaaatcaccgttttgagcctattttctaggagatttttaaaaatctcctgatgcgctgtgcacatttctccgtgcttttaatgcgcatgaagccaatcaattttatcttttcaaagagcatgtacatagtatcagagtatcaaagtacttcaagacaccaatttgaacagtatttcaactttgtcaaacagctgacactccccgtagttgaaaccaggggttttacgaaggttttgataatcagtcaggaaaacaccgtgagcatcaagaagaatcgtgtcgtatccatcgaggcggagttttgccggttgttcagatgtctgattctgcacaaccatgtcccccgcctcgtacctcatcttccgcgcatgctcgatatacgccgttttaccaaatcttcgttttcacctcataaagaccggccggcgtagtatcaataaaacaagcctttgacttcggatcattcagcaccttgttaaaggtgaacaccaggcttccgccaaacgtgttgccgccgagaatcttggtgtccgacatattccgaagtccgcttgcctgttccattacctgaatttcagcctctgcaatcttgtaaacgatagccgggaattcggattcactcgttgccgcaaggatgtccttcggatgctttagcaagccaagcttcagctgaaccgtcagtttcgggtaattgaccggaagtttctcgaggagcagatcccaaaatccaaccaaagactctgcggctttctcaaaatcaatctttgcggatgctccggcatttcctgccgctgcaatcgtctcaactcccttcagcaggtacacctcatcaatcgccaatggcatctggcgcaccggatacacctgcttctcaccggcgatccggaagcgctcgccataaagctcgatcatcgtgttcttaagaacacgggcacgaacgatgcgaacgaatttctcttttgccgttttcgccaaaccgcgagcatacatctcaagcatagcgttgtaagtatccggatcagatttcgatgcgatcgcagccggtaccgcaccgaaacgaagctgtttcacctttttcttcatcacttcatagacaaagaaattggcaaacgtctgagagctgtacccaccataaatttctgccggacggtctgacttcgtggcaatcagtttcgacttctcccttggagagtaaatcgtctgtttccaaaaggcgccgccgtcttcaaaggcggcatatgtgacacgaaggttcttccatccacatgcacgatagatgcgctccacctcttcatccttgttccagtaaacctcacctgtgtccttgtcgacacggtcaaagaagaaaccgccggcaaagaaatcaagttgtgacttcggagccttcttgttctcctcattaaccagcttgatcttgcgcatgtactgctcatacttaacgcgattatggacgaacgctggcttcgcaagttccatatagcgcccgacctcggctgcaagcagagcgtcgtgtgcgtgatagaactggttcgctttaaggctttttggaattccgatccggctacgcacggcaccgataaccccagccttaacgggaatgacaaccgttcccggatactttgccgcaatcgcagccgtaaacagttttgcctcccagctgttttccgtgaactgccttccgataatcgatttcagcatgccttcggaaatctcagtacggatcagcgcgttgagctttcgctcggacataagtccggcgttacgaagcatcctccaaaatggcagcatcttccgctgcaccgctggagacacgagcagagtttcactcttataacgactggcctctgcataaacaagcaccttgttatccagtgactcatctttacggtaagcaagcggtacaacatggtcgacatagtaatcattcgatgcaatccgagtgatgtcgatcggctttcccgtataaaggcattttcctgcctgatggaaatacaggtagatgcgctcgttaatctccttctcatcgaacatgccaagctcacgaagcagcttcgccgcaccaaggtccgccgctgcatccgcatccaatgccttgagtgcctgcttgatcttatcggagcgcttggcggttcgcttaccctttcggctattcgaggcggttcgcgtcaccttcagataaatgcgatccggagccttgccagcaacagaaacgatgtcatccaacacctttatcgcctgactcacgcctcgacgaagtgccggcgaaccgggaagtgcgttcagatcaaaaccttctgccatctgcatatgcgaatcgttaagcctcttgatttccattttgaaaccaagaacatcgtcattcagaatctgcatcaggttcatagatgaaccacgatagcgaccataaggcctgccctgctcaaggacatccatgacgcacatatcgccagaagccgtatctgcccagatgccggtcagcagtctctcagacagctttccccaaccggaaaggcgcttatgacagaaatcgtcaaccgccttttccgtgagcaggtcgccataggttttcagaatctttcggcgcagaatatcgcgatcctcaaacactgtattccacagaaccaggtcctccgccatgctcatgtcggaagcactgagcgctttcacgtcgaagagcctgcagaaatatgcataattggaccgcttggaagacatggctttcggattcgacgtaccacgaacatgaggatgtgcgataaagaagtctcgctgcagcacggactcgatgcgtttcaccgtcatcgtctttccatccgaagcggcatcatagatagccttccgcattcccgcatcgaatggcatccaggaatctccatcctccgtaaagctgaggctcgcaagctcattaaagaaacaatatttctcatacaatagagaattcttcgccaaaacatcctcgccgtcgagataggagcactctcccgtcatgcggcggatgaaaagctcggctgtcgtgtcgatatcaatatgatcctcataattccagggagacacaaatgcgtcctcatgaccggcaagacgtttcgcccatgcaaaacgcgtgccgttttcgccggccttaccatgatccgtactgtcaagaggaccgacataatagggaattcgagaagtcagaaccttcagaatatgctcgcgagcatcaatgagccaaggatagaaacgctcctgactgtcgatgattcgatttacaacctcggcgtgcaactgatagggaatcgcagcattgtcgaccgtatgaatacggcgcaggaaagcatgatttgcaaatgcctccatcatcgtcttgtattgcggatcgttcacggcatcggtatctttgaacaggagctcaacacgcttggcaaactcctcataaccgagaacattcaggttgtaagcggtatagcccatattgtttttcgggctatcctgcttcttcacctgaaccttgtcgtagcggtacccgtcctcacgcttcggaccgccaaagaaccgaacgtaatctttaaagccgtcctcgtcaacattaccgtttgcatcctgcttcgcgacatacttgagtgcaagatctttaagcatgcgaagctgcttcccatacacgtcatgctgggcaacctgattgtgcgaaaggcttttgccaggtgcataagaaagcattccctgaagcttccaggaagtgtagagcgcctgcgctgccatcagaacaggaacgagggaatccggacaggaatccgccaagaactcctccaacgcatcgccatcggaaatcgatactttaggaagtttctcagcatcgggaacaagcaccgtcagatctgccttatagccggcgacaagatctgcaatggctttaatttgagccttctccgttttcttctgaatatcatcacccgacacgcacatggcagatgcgaactgcttctgcagctcacgcgccgttacatttccattgatgtcaagagcttccagtgacagctcgattcgctcgtcaagggtgtcctcaaaataggacacaagaacttccgcgtagtttgcaacctgcgtatcgatatcagagttcgtagacgaaacattttggttttcgagcagaaaatgaccgcgccggacaacatgattcgcaacggcctcgaaaatcagacgtggatccattgcactatctgcttccataagggcgacgtccagatgggcaagcgtcgggaacgaatggaacagacgactatagctgaatccgatcgggtcgctctcgaaccgaatttttccaagcttgtaggacatccggcgtcggataaagaaatccggatcaatagaggaaatcaccggtgcgaaaacgcgctccatctcatgttcacgtccacgacggcgctggattccacggcgggaagttcgcggcatacgcgcctcagctgcatgttgaccttccttgaaaacacgggttcccataaccggttgctttccatggtacaaaacattcccgttcggatccgttgcaacgaatccatgtgccgtcgaacttaactcgaacccgatggaataaggcccactcatctgcttcaactttttcatagcgtatttcctttcccacacataggcggtatacggctttctttttgtagtgtcattataccacagtaccaaaatattccagttgtgattgatgattctctaccgttcaaaaaattgcttccaaaaatttcttcagaaactttcaattcccgcgtcccatgctctcctgctgtgctatattggtcgtggtgaattaccgcttggtttacggtatgtgtaagtcgaaatacggcttcaaagccacaaactgccctttggggcgccccgtatggggcattttttttggcgatttttactgaagaagaatggtttctcatagaaaaggggttgctggaatatttccagcaacccctttatagaacattttgattcaaactgtcatatttgaataccaaggcttttcgcaagcgcttgcgaatcaccctgtcgagaccaatatcctcgaatagctttcggaacgccaaaatccaagcgttcagcatcatagtaatgctttcggcatccatatcaccttacctacaacggtcttcttccggaataatcttgttcagcgtattttcaaatactttggatcctctttttaccgcttctgccttctcgctaagtggaagacctttcttgtgaatcatcttaacggaatcaagaagcatcggtattttggttgttgcttggatctcgtcgaatttctcttccatcgctttgcaaagcgcatgctcatccacgataggaatccgtagcaattcccttactttctctgtaatatagtggttcagcgctccaagccgatcctgtggaagcggatatgttggatgattctggaactcaaagccgatcatcctgcgcaaaagctcatgctgctccgctcccataacaattccagccatatcattaaaggcgatattcgctgttgcaggtaggtaatatcgatttgaacgatcaaggaaatccgcatagtctgtctcatcatcttgcgcaaacaaagacagattgtggtcaaacaacggggctaatcccaacagccgtcctgttctgttttcccgtaagataccaaaatttccgccgtgacgatcccgattgcagatcaaggcatcaaaaacaaccattgtcctgtatttcgatgccatctttggattaagttcatttaagattgataacgctgccgggaaacttgcatcaccagcagcaacgaaaaatggaacaaaagaaatttctttgtcattcataagtccgcagacagacgcaagtttccctttccacatctctaaatcgtaggaaacgtgatctattcccatccgttttgcgacttgtgctgcaaagtattcagaataaggttctttgccgagatttctggcaccgcttgtacctgttttgaacaacagcagcctatcgttaatccgtcgaactgctttcggaaattgccctcccagtgtccactcacttgaaacgccagctttatgcttttgtgatggcgtgtagccggtataagctacaagtcccaatacttcatcaaagcgattgtcgaacaaattgattccatcaaaggtaacatctgatttcccatcatcaagccaatacgaatcgttaatggaaagccctttggatacatcaagaattccaaggatatcattccttgtcaatcctgccgtactaagaatctgctctacaaatgccctgtttttcggaatggttctaccttccatccaactcgcaaggcttttttcatcttgatctacaattaaattcaatggaagcaaatgcgcatttgccgaatcgatatccgtaatctccagtttcaaactaccgaatgcgtcataggcagcttcgaatctcatgaggctctgatcatagatcttcagctcatagcttttagtctctctcgtcatgctgctcctcccttttcttttcaatatctactattatagcataatactatcgtcctatgcagcttataatttaccaaaacggttgtaaaaccattggttttagcaatggtaagggccaatccgctaaaatgaactcagtgatctgtaatatccaaaagaaaggaaagtaccatgccaaagagtatcgaagacatcgatcgccaaatcgccgccctgaaggaacagaaaaaacggcagcaagcgcaaatcgcccagaaaaagcgtgaaggtcttcgctcctgtaaagagcttatcggtgaagaggttgtcaatgcgttcgataactggaccagtatcgaccttgatctttttgccatgtatatttccgagcatgcagacgaaatcgtaacctcctgctcgacttctgaaacggatctggatgatgctttgaagcgcaacaaacagttcgccaagaagcataagaagacgcgtaagaagacgaacgatcgagacgaacccgagtcggatagcgattcgtctgaacaggacgatacacaggttgattcctatgcggtgccctacggcgcctattgatccgctcccctgctcgctgactgacagaatctaaaaggaaaacgcaatgaatcccaatttcaaccgacgccaattcatcggtctcgccgtcggcgttgccgttaatacagcacttcccggatgcaagaaaaaagaacccgagtggaccgcggcgaaagacgataaactcaaacccctggtctttgaaatctcagagggcaaggcgactcccctttccggatccggctggaaacgatgcgacgattacattcatctccagctttccggcagctccatcccggatcgcaagattgcgaaagtgaaacaaaaaaagggaacgctcatcgtctatgtcgataatggcaacagtgaagttcagtcgatggatctcgtacttacccaatataagatcactggcggggatatttcccagatcgtcaatctcgtcctcgacgagaatggaaccaggactgaagttttcaatgcagacagcaccggcagtctggatcgctgatctaaaccgacaatatatagacatgaaaaaagggagatccacgtccaatgtcattaagttaaggaaaaataattagattcttatattagaaataatataggagtctttttattttgtaaaaatagttgacaaacaagatagaatgtgcggccgctttcgctaccgatatatattaaggttgcgaaagcggcccttgtaattaaggaatatcttgattgcaaggaggatacattatgagtcactatattgaaaaggttacggtttcactagaaaatctaatttcagaattggcaagaaatccatctttgttcttgaaaaatccagatactgatttttcaagaaaccgcaaaattaattttaagacatgtgttggcattaccatgaattccggcggttgcacgctgaataaagaactcttggattttttcgattttgatgtgaatgctcctactgtttcagcgtatacacagcagcgggctaaaattctaccagaagcatttgaatacttatttcatgcgtttacagaagaaaatgctcaaacaaaaaacttatatgagggatatcaacttttggcttgcgatggcagcaatctaactattgcaccgaatctaaacgacccggaaactctttggaaatcaaatcaacttggtgcaaccggtaatcacttacatctaaatgccctgtatgatgttttaaacagaacttatattgatgcattggttcaaactgcctctacgtatcaagaacacagagcatgcattcaaatgatagaaagggtgacattggacaaagttatattaattgctgatagaggatatgaaaactataacattatgtctcacgcaatagaaaaaggctggaaatttttgattagaataaaagatgttcacagcaatggcattgcatcaggcttagaacttccacaaacggcagtttttgatatggatatcaatctgattctgacacgaaatcaaactaagtcaaagaaacaagcaggatataaattcatgccaacagtacaaacctttgattatcttccaataggaagcaaagaggattatcctatctcctttagaattgcaaggtttaaaatagcagatgattcctatgaaacggtaattacaaacttggaccgtttttgcttttcggcagaaaaacttaaggaattatatcacttaagatggggcatagaaacatcatttcgtgaattgaaatatgctatagggctaactagttttcatgccaaaaaagtggattacataaagcaagaaatatttgcaagattgaccttatataattactgcgaattaattacaacatatgtagttgaacacacagaaaatataagtaagaaaaatcaggtgaactttactattgccatttacatttgcagagaatatctgcgacgcaaacggaaacttcgtccacctgatgtggttaaactgatagaaaaacatatattaccaataagacctgggcgtcgagaccctcggaaagtcaaacatcaggcgtcagtaagttttctatacagggtagcataaccattcatcattatataggattatagacagatgtacaatccatctgtctgtttgccgtgcaaaaaaacagataacaaaatgaaaaaagcaaaatacaagtgagattttacctacttgcattctgctttttttaatttttaaattaacttaatgacattggatccacgtctcccttttttcgtttgcttcacaagttcaggtcgatatcgaagcaataacgattatagacgcttttgctatttcgtaaagaactcatagcagaaggacaaaataatcgcggaagcaacggcgactgcaatccagatcgcgatgttcaccatcacttccggctttgtgatacgcatgaaacgcttcgctctcgcattggcagcctgttcaagcttttcgattgacttggcgcttttcttcgcgacctcatcgatcgctttcgttcccgcctgtacggtttcctcaacagcttgcgtcgcgccgtcagtcacagctttcgtcacggtctcagcatacttgtcaccctgctcgaaactggcgaccattttactgagactgttttgagcgcgacgcgtggcgctcgcctctcgcttcatatcgctttggattgatttcatctcgtcgagaatcaaatccgtacgttgtttgaaatctgttgcagtagaagacagtgagtccttaacctccttccggaacgcatcgttctcggctttctgatcttcaatgaacttttccatgaatccgataagctcaccgtaagattccggagtgtctttgtcacttagaaacggggtctgactttttggaataactgcctgctcctgttgatcgctctcgtcggggtcgatctcttcctcgaacgccgaaccaccctcctcctcttccatctcgtgatccatatcctcatcggtcttcacgttttcaaacatatcgtcttcaacagatgaattctcgtcgatgtccagcatgccctgtccttcctgattcttaatggatttcctcgcaccgccaattggtttcgacataagcatctacctcctgttccaatttaacattttatttagtgctcgacattcctatcgctcagttcgcgagtgcgaccgctttcgataaccggatgctgaacagagtgcgttcccgcctggccggcagctcgaacattgtcctcaccatagtcgggcacggcactggcataacggttgcgaatctcttttgcgtaaccgcgacgcgcaagcagctcatcgcgtacagcaggatcttcgagcaggtcttcgtcacacttcggggcaacgaatttagggaatgcgtcataggacacacccttgctcgcctttgcctgctcaacccacgccgagtaagctttcttaagtcgttggatataaacatctcgacgctgttcgtatgtcatcggtttctcgctttccgtagttcctgtttcaaaaaccgtctgcagtgatttcaacgcgaagcgcccgtcaagacgagtcaagttgaaggtacattttggattaccggcctctttgatatcgagatctgtcgcatagactcgattgttcttgatgaaaatatctacaccccatgaggcaagtaattttttgaactgctccatattcttcggatgaccttcgttgattgcaagatggatcaactcgcgcagattgtttttataactgtactctccccgatcgacaatctccttttcgatatcgcgcggctgtcgatctcgaatctttgaatttttcttacccttttcaagttgagtaagattccaggcctcgtccatttcacgaacccatgaagcgcgtttatgtttcgcctgcgctcccgttccctcccaaagacgtttacccgttagaagatccgtgcggttgatcgccatatggaccgcgaaccgttttccctccttatcgctttcctcatgcaacgctagaatcacttgttgatgcggatagtgcttcgcaagccattgctccgcgtaggccatacatgcatcggggggcatcttgcctccgttgcagctgcactcctcgggcagaaacgcaagaacctgatgatacataatcgtgttcttcgcaccggcacgtgccggtttatcatgaccaaaagattttcgcgtccgtgccatttttgcgtaccaatatttgttatatggaagattccagccgccacgtgcaagcgcatcttttccgttgatgtatttacgaacgtttttcgcgtgccgcgacgagctgactgctttctgtttaatgactgtcaatctcttctgccatctcctttcgattttaagcagtagttataactgaacgttctcagatatataaaatcattcctttcttatttcagaagccatttttaaaattgcgaaactgatctagctgcgttctgacttaaagatttttgttgtcaggttcatctgccagatagtcgtggggaacatagtcaacgtgataacgcttttcaagttcctcgataaaccggtcgacctttcgggcgttttggtaaaccttttcaagcgttcggaaaacagctttctcattgtacgcgggaagcccttgggcgttcacgaagtacatcagctgattgaggttcgttccttccttcaataactcgtgatgaagcttttcaacttcagcgatatcgaaattgaatgattcgatctttccgtaaattgcgctgcggcgaaccagttcgcttacagaaatgccgagcgccgctgcacgttgctcaattgcctttttttctggagcagtgagcattacacgaagataagagtttcttttttcagcaagcggctcgccacattcatcaacttcgcgtgcgttttgcgctttcctaaagtcagattgttgtcgatggagagccttcttttttctatcagaaacctgcatatcgtcaccaagatcttcaagtgagatttcccgatgaatcaacacagatcggatcaactcagcttccgtacaaccagcttcctcgcatagtgcgcgaaagattttcttttcagctagagtgagtgttgcttcaaccttttcagttcttttcatttatccctttctatcggagaggcctccgatacaaattaagcaatctttactgaaccggcgtcagttttatgatgccggtttttgacatttttagaaagtgcgaaaccaacacgcaaaaagcgtgctgcagttcgtactttcgccttttctccgtgacaggagaaaagcaagattcgtagatgataataacacgggctatgcccgtagttattatcatctacgtacatcttgcaatctccggaacggtgattgggcgaaacgcagtgtagacgtggaatgagaggcctcattccaagcgagaggcctcgcggcgtcgtaactgcgtgaagaccgtgagcgaaagcgaacttttaacgcgagggatgccgagtgttaagagttcgctgtagcgagagcgaagcggtactgcgaatgcgagggatgccgagtatttgaagtaccgcgcagcgggctccgggcaaggcctggagcgaatcggtgagaggcctcaccgatcgcggaaggttttggccggagcatccggcatcgccggatcttttcgtgatggcttctgctgagatagacagctttcgacatttcaatgacgcgaagagtctttagtgagactcgtagcgttgttggactgtcgaaaggtggcgcgatttgagtagcgatacgatcaacgaatagattttcacacgccgcctgcggcgtcgatttatcgcgcccgttgggcgctatgatattgaattcatcacattttgaattgcaagatgtctttaagtatgttttggaaacttttcaacacagtttccggttttcgataatttcaatggcgcggagaatccgaagggagtaattcgtagcgctgttgaatttgtcgaaaaccggccgctccatttttgtcatcaaagcaagcaaatcaaaaaacgaactcgacttcgcgatcttctactcaatcccttttcaagactcgccatactttacggcactattgataaaggtatttcttagatagtaagcaactaaaacataaagtgaaatcagctattaccaagaaatcgttttgatcgtcatattggaaaatctcgattaaaaagggctcctcattcgagaagccctaaacagttttgatgtccgatgcacttggacccaggcatcaattttaaatctaacggcatgccctaactaagatattcaagcaaagcttccgcctgacgaataccaagtccgccaagacgacgattgcctgggatgtccacgtcgtgcataatcttatccgccttcgcgccaccaatgccgggaatggcctgaaggaattccttaaccttcattttactgacgagcggatcgtccttacgagtcttaagaacagaagccggatcagtttcgccggacttaatgttctccttaagctctttacgcgctttgcgcacctgcgctgccttctcaagcgcctttgcacgctcttcaggcgtgaaattcggaagtgccatgatatctccttctttcaactttcaaactgtttttaattcttttccaaaccaagatcgattacatacggcgcaactcgatatccgccgctcttgctcgagtccttcgattcctcgttgtgcttgaagagaatgcagatatgatccttcagatcacgtccccagagttgcatgacctccttgccgcgtcgaccgtcagtacgttcgcttcgaatcgtctcatccgaatctccgccaagttgacggaacgtgatgacatagcgctttgaagactcttcaagtacggcgctaagcactttgacggtaatcttaatagaagactgcacgagcatcgcaagggatttctcgcctttagcgcgagaaatcttcaaaacctcggatgcaagctcgcactcgctgaccttctttcctgaaagcataagcgaaagatacgcaagctcgacattgcgcctcttctcgttttcctccattagttcatcctttctgttattggatttcgcaagcgcttgcgaaaattaaacctgatgatcgctgagacagctcaaaataaataaagaactcttccaaatagttcctgctttaatttttgcaagaagccccaacataaatagactgaattcggaagtcattacatcactttctgattcaggaaaacgccagacatggatcgttgcgtccggttcaatcgaccagtctttcaaaacatcttgaaaaataacgcctccgcgctgcacggtcagatcgatttcatgttttgtgacatgaagcaattcaagattgtccgcaccataagttattccgctgttgaaataaatttcaaactttggatcataaagctcgaacccgccatcgcttatgttgcaaaggaaatcgataacagtttctggatcaagcactgtatcagacttcattccgatgcgaatcgtatccagaatgtagtcctcaatctcttgatttctaactcgcgtcaaaggacgttcaaacggcgatgcgcaatacgggcagaaattcggattcgatgcagatggactattactctgacaatccgcatcggttccgaattccgttatccgatacgacctaccgcaaatggaacaagtaatcaatccacagttattattttgtgccaaattgtaggcgcttagcttttgcacccttcatccactcccctcttttttcaacaaaatcgtcaggacatcttcttcctccccgacttctaaatctccttgccgcaatccgggcagaactgcgcaccgacaggaagaatagcgccgcaatgcgggcaaggagcaagatcctcccaattcttcatgtccctataaagagcaaccagcacaacgttattcatactttcgttcgtctccatgcagtgacgcttcaagagacgatgaatattcgcaggcaggcgaaggttgtagccgatcacgtctgcattcttgtcgtatttcgcacgacgagggttatctccctttgcaagagagtagatcgccggcacagaggtgctgcacgcatcggcaacagactcggcggcaacctccttgcggatatcatcagccatgtcgaatgcgtcggaagttttcttgctcttagccattctagtaatcctctccttcaagatactcatttacaaagtcagtaaagtccgcaaccgcgttgcagttcggatcgtaatcgaaaatcgaaacgttagcagactgcgctttatttacagcctcgcactttcgaataatcgtgtggaacatctttgtgttagcggcacgtgcgatcgatggaagctcattaaccacaccgcgcgaaagactcgtgcgaccatcaaacatgttgacgacaataccggcaatgcggagattcggattcagacgcttgttgcggcgaaccgagttgacgcatttctggatattggtaaatccttttagggatgaacggttcgggattaccggaacgatcagctcatccgcagcaaccatcgcattgcgcgtcaccaatccaagtgacggcgggcaatcaatgattgcgtaatcatagtcatcatcgataccctccattgcatcggcaagcatcgtaaggcgcgtatccagtttcgccatatcgctttcgacattcgaaacaaggacatcgccgggaataatatcgccaccgtcgaaatgtttgattccgtctttcgccgtgtaatcgaacgaagtgagaagatcgtaaaccgtcacttcatccgtcgtatcaatttttgcctgttgcgttgcgttcatctgctgatcaagatcaacgagcagtgtgcgcttgcccttacgatgcagcccctctgcaatcgccatggacagtgcggtcttgccgacacctcccttgtgattacaaatcgcaatcgtcttcattttcctctcccaactttcctttcccatcaagatcaaaatttgatttcgttgcatcctttttcatctctgaaagtaactcgccatcatgtgccgccttgcacaaagcttcacaaaataccattaaaagcgttccgagaatcatcgaggtgataacaagaacgcccgtttcgaaatgaacgagactatgtagcacaaggccaatcaacaccattcccggaatacctagagcgatccaaatcagatcttctttcagctggttcacaggttgatccctccttccacaatacgataataccaacatgcgtatactatgatgacaacatagtacttgtattcacaaaacaatcctattgcccaatcattcagcaataaacctgtctaattaacttgaagttggtataatcgatgtgatgagagggtggcggcgctttccttttgttcttgcgtcggttgcaagtttttcctttcgccaccctctctcctttatctattacgcgttatttacgcgcaatgcaaaggattagaacgggatatcctcatcgtagacgtccatcactgcgggaacatccggaacaacaggcgtctgctgagtctgtgccgccggcctgttagcggaagcattctgagactggttaccctggctcatgaagtcgattgtatctacgacgacggtaaggcgagaacgcttctgaccgtccttcgtctcccactggttaaagcgaagcttgccgtcaatgctgaccttcataccctttcgaacgatacggcccacggcctcggcacgcgtgccgaacatggtgcactcgacgaaattcggatagtcctcccactggttggtctcgcgattgagtcggcgatcgttgacggcaataccgaaagagagaacctgcgtccccttcggagtcatacgaagctccggatcgcgcgtaagatgaccggaaatgttgacgcggttgatagacatgttcgaggtcctttctcctcttggttattgactgatactaagataccacaacacttcagtattacgcgtgaaaatgacgatttttttaaagaaaaataggcagaaagagctgtttatactccttccacctattttcagttggcgtaatgcgtcgtcattctgctatttaattttccaccgatagcggaattgcctatccgcctttcttctcaatttactgcgcctaccgagcattaaagttattatttatctcatctagactgactcttctactcacagtatctctcttcttttcgagcgacatctgatgggaccgatcttctctctgaactgcactctcccatgtcttacatgtctcccgacgtaaaaaaccgatcagcggtttcaggtcacccgtcatatcaaaaccgtccagtgccgcataatagtctttccggtcttcatcgaaaattacgatcggaggatggttgtgcaatagcagatagtaattcatcatcgctctaccagtcctgccgttcccgtctgcaaaagcatgaacgccctcaaacctcgcgtgccaaaacgcagctgccaccagaggattttcatctccaaactcggaaacctcatcaaggtcctgctgaaggtcgtcctcgatctcatctacaggagcggcaacatcatgcatgccgactccccataaatcgtttttcttgaattcccccggtctttccccaagttcccaacgccgctcgttgtaagtgcctttcgtcagttcaaactgcatctcccgaatggaatcgagcgtgataggtttacgctcatcgaaccaccggtacatcagctcacttgcgtctttcagattcttaatctcgtaaagcgtccgcaggtctcctgtgtaaccgcatacacggccattcttaaaaatctcgtgcgtatcatggtaagtgatttctctattctcgattttccctgagttgtaagagaataatattgcaaaattttccaggtgcgctgccaactcaagcgacgtagcgatactgtaactgcgccacaattccatagtgcgatcgtattgtctatctgaattcataaagtcctgcctcttcttttcaattcgatatttagggaattctccctttttatattataccataatactaacatattgcatcatgtaatctacgaagcgctatcaagtcgtcctgcgagtcgacttgcaggacgtatggcgatgcgcttttcatgcggtgccctacggcacctattgatccgctccccgtggtcgctgatagatttcctagacagtgcttcttttcaaacagacagtcagattgtcgctatagaccggcttgaatcccgattcctccaaatcttgaataccgacatcattgatgccgtaattcagtacagcgtaatccattccatagtcatcgcaaatggccgataggcttccagaagaaagcgcctttcctgcctcggcaagtacattcttctgcccgttctgcccattgaacacctcaattctggtatcaagatacggcttgaacccgtttagctccgctcggcatccggggtcaatgtccgtcaagactgccgttcccgatacggcgacatcctctctcattgcctgaaacgctctttcaatcgagatggacttttgatcggtcgcagacagcgtgctataaaacagaaccgctccaaactcaagtgcaaccacagagattgaaaataagactatcctgcttaacatcttcgagctcaccttgcactttggctcaagcttccagcaccacgtgctgtagacgatcatcaatatgccaagcagcaaaagttcgtttcgccatgtcatcagggatagaaagagcagtcctgagatcatcatcgtttcgaacgaaaataccgtctttttaaatcccaagcacttggcatggaagatcaccggcacgaccgagatgacaatgagtatcactgcttcaaccggaacgatggagaacatcggtttcagttccggcacggcaaccgtggcgatatctgacgtgcctattgtcttaaacggaagcgacagcacgtctaatccgtatggattcagcattgcggaagcgatcgtaagtaagatcgtcacagccaatgcggcccgcgcattcggatccagcttactatctaataaagcggcaagcggcaacatgatcgcgcagggccaaagcgcaccgtgcagattggctataaaaatccctaggaatggaaaaccaaacagaaatctaatatcgcggctttcaatgtatttctccatcaactcccaggaaacagccaagcacaggatatcgagcgcacgcggtgtcgaccgaaggttataaacgattaccgctccgaatacgcatgaaacagcacagtgaagaatgcggtttccagcttttggaaaagtttggtaccaaatgaagagaaccgccaccatgtccaacagcgcaaaaaacagccgaaccgacatctctccaaaagtgtcgtagagaactgcaactaatatgcagataggatattgctggcagatataggtcaattccgaatggatcgataacggatcggttgtcggcagatgaccgttggctataatccaacggccggcggcacccatatactgcgcatcggttatgaacaactctccttgtagggagcgaatgctcaaagtcaccagcaagaccgtcaataggacacagaaagagaaatatcgagcaggtatatattgaggcttaatgttgagactaaacacaattaacgttctcctgaaacggaaggtggaaccatgtattcaaagtgaaaacccttgtactcccaaccgccctcgatcgcccgctgaagatcgtacatgtgacatggacgatcatatgcgcaacattcatgctctctctccagcaaatccagcaaatcggataatgtatcgaacgtcttcccggtctctcgacagattaaaggcgtttccttcagccttttctcgaaatccacgtcgtatcgcaaaagcctccaagtcagaccgtcaaaaacgattcccttcttgcctgaattcagtaaagacttatggtcgaacccgtaccacctcgttagctcaagaaccgaataatcgcaccttccccgctcatagcagatcaccggctgcatgtccttaatgcgctcgccggacttcagtttgatatttttcttccaatcgtctttccaaaaccaccgttcacccctccagcgtgtcgcctcgctggtcggctcgcccttcgcatcacagattgcaacgatcttcttccagtcgacgtaacgtgagccgaatttcagcgcgtcgtgcacatctgcgtactcgcgcatcgttgtcaactcgataaccggacgagcgcacagccttttctcctccatgtaggcttcttttctctcttcaaggttctcaccgtttgcccaatgcatatcaaaggcagggcatccatgccgtatggcatctccgaccttctgaacaatctcttttcgcgttgcccagtcatatccatcggaccatattgcggcacagatctcgtcataactgtgatagatggtgtccgtctcaagacaaatcatctgcacattcagatctacaagtcttcctactttcccgtcccaatccctcacatatgaaaatctcttattctgaggcttgaccttgtttttcacatggtctagaaccaccgacctgcttgtcccggcagcctttgccgctgcacccgtagtcgggaacatctcccccgtttccaatatgacgatccatccggcaagccctcgaatctctgtcagatccatatccggcgaatacatcgactcaaaacaatagaactgatttttgatcgcgacccatttgccgttctgggccatattgcacacatccgacatccagccctgggtgatcccaagctctttttccgctgcactacagctcggccacttcttgccatcgtcgattcgaacaaccgattttgccgttctgcgaacaggagtatcgaatggaaactcggcttccttcaactcggcaatctgctgctcggtcagctctcccgcgcgataaaggcggcgaagctcatattccagagtctttttccgtttgagctggtcctttttcctgtcagtcatctgctaaagccccttccacagcgctatcttctcatcaattgtcagtttctcggatcttaatgcgagccgtcgttcaaggttttttgccaaatgccttgcgtccttctcatgatcgatgaccttgaaagctgaaggcggaatgagttcttccggatcattttctccagatagccgggcgtagctttccgacatcatgcttacgatctgctcaattccgatcatctcgaaattatcgactagatcgataaccagcggttcgaagttgcctgcggcggtcaatgcacgtccaagctgctgatagaaaatcgtcggcgacgaggtacgccgtaccataatgacggcatccacgcccttgatgtgaacaccctcgttaagctggttgacgcaaagcaaaagcttgattgcggtctcgtcatcgtcctctttgaacccatcgtattcactcgtcccgaagggattcgagctatggacgacataggtatggacgttaccgtttactcgagaaaaccattgcgggcacatcttctcgatttcattcagctcgaagacattcggacaaaatacgatcactttctctattccctcaaagtacttttggaaaatggccggaaggttcgccgccctgctcgcgcaatctctcagctcgttaaaatcagccagcaactccgcccgcctacccgcactctcttcctttgcgatgcgctcgccgagatcttcaatgtagccgttgatgctgtacccggcagtcacatatgtcggaacaggcaggatgcctaaaacccagcaatccgtcaacgacatatatgaggcgatatgcccatcaaaaagttcatcggacatatctcggccgctatcgctgtatcgaatcgaagtcgcgctcaatccgatcagattggcgtcgggattgcattcgataactccttcaacaccacgagaccactgcggtgcccccgtatgatggaactcatcgaaaataaccgtatctgcatgaatatcaagatttcccttttgcgctcgatgcatggcggtctgatacgtcatgcgctcgatgttcttgaattcatgattcggcagctcgcgcctgatggaagcttcctgctcctgctcgatataggtcgagggcgacatccagagaattcgctcattcggatgatcgaaggcataacggtacgctataaacgccttgcctgtcccggtaggatgaatgatgcaggcacgcctggtcccagacaacatatccagaagtttgcgatacgccttttcattatgtggatacagttccagtccgctcggcatctcaatcccctttgtactcatgtaaccatggtactaggataccataatgctatgcagaaacataaaagaaggtacaatctggacaattaacagattgtaccttcttgtgaaaggggatttatcgacgtggagtccctgcggtatccatgtgctcccccgcgtgtccgatcacgatcttctcctcatccctgtcgatataaaagtggagccggaaggcggccttgatgttccttcccttgatatgcggcgagatatcgatctccttgcctttgtacatccgcttgcggagcttcatcaagttgggcatcgcgcaagtcgttccagactctccgcgagccagctcatatccggttcgtttcttgaactcagaacccagccgatcgttcaccgtctccttaaagcatagatcccagagcgtcgtcgcgacggcaaccaagatttcccattcttccgtcaaaatgccgtcaaatttcttggcactcctgtaggcatcgggaagaatcacgattctgtccggatagagcaccttcgccaaatcaagcagctgtgtaaggttttcaggcactaccgtaagcgccttgcggatgccgtttaacgcattggcgtttagctgctcgagttctgccatctcgagcttacgctcgacggctcttttctcgttttcaagtcgcatcgcatcgcgcgtgagcatgtcgatttttgcagccgcttccgagttcgaagtctccaactcgctcgcaatttcctcccagtccgcgatgtccttttgaagaccgcttatctcatcgcgaagcgaatcaaccgtttcgtttccaccggaatcgcctttcacccgctgcttcagtttcttaatccgtgaactgaggcgtttggcctcatctattccatctaaccatcggacatcggcgatactcaggatatccccagccaccctgtcgctcgcacggcagatcccctgacgaaggacatttatgaatcggttttcgccgtagcgcgtatatcgatcgatcagatacttggcataagccatccccatttcattgtcagttggaaccgtgagatcgaccggcttacagtaaatcttcaggcttgagcattccatgccgtaatcataagccggcgtgttcttcagaaagacctctcgataagtgtccataagagcacggtcgtgccagtcaaggacatatatatctgccatcccgaaaagctgcttggtcagatttttcaagttcctgaccggcagtttcgattcttcgtcggtggtgattaagatcaaggaaagagttcgattcggatcggtcagatccggtatgaacttgctcgtcaatgtctcggaagtcaggtatatcggcttatcgttcaaaaaagtcgagccaacgcgaacgacattcgcctcatcgctaaaaagcatcttcacgatccgtggcgtagacggtatcggcggcgcagcctccccaatgaaccccctgacgatataacggctcaattggatgttgacgatacaggaatcggcatttccgataataccgatcctcgtatgccaacggccatagatcagcctgtgatcctgttcatcaagctccatcgcccacacgacacagcccgggacgccactgttccgctttgatgcaagggcggtctttccctgttcaagttcagttgtcccattccaaccagcaggtgtcgaataggtaccctctcggaaagaatcacagtgctctttcgatagaaccttttttttcattagccaggagatgacagtcgagatcaccgactcactggcattttcattatcggttctggtgatcgtcaagcgtgtcgcgtattgtctatcctcatctacgatcgcgtttaccagctgaagctgctgtgcggctatacccgcatcaaggacggttgaatccaatccggctgtctccagcacagctgttgctttcttttccgttccatacgaagcctccgccttgccgggacagagggtgagcggcggttgccctttccgcccccaattccttcaattctttaaaatgagatctacgatactgtaggtggtatcccctcccattattcccgccgcctgctgaaggcactcttgaaaataagctgcatcttccctactccggaaagccatgatcggtttcgaactttccggaccgtttgccataatcgaaaacacagtctcgtctgccgagtcgatcttgttttccgtgtcgttgcgttcttttccagacataacggaattctcctttttctcatctgaacttacagaatcggtctcatgtccgcatgagacttttgcggggcatttgggcgactcttcatgaactttttcctgctccgcgtaccactcattgaaactggcgacgatctcagagcgccgaccgcgtacactcttgacaacctcgtcactgccgtctgccggggcgtaggtgaaaagaaacctaccgtgagacgtctggtgccttgtcaagcgcccatgttcaagcacgcatagagcctcagattcctgtggagcaggaggttgcttttgtgcctcccgtccgctcatttcgctttcaggcagcctttcactttgctttcggttctttgccttattgctcatatggcggttttccttttcaagcttccggcgctgctctcgattcagcttcacctccggatctactccctgctccttggcaacggaccgcatgtcgtatccggcagcggacgcggcagcgaaaaactgcttgaacgccacgggtcgattggttccaagctgcaacgtcttgaattgcccatttgaatccttgatgctcgccatatatgaacccttttgttcaaacaggcaggctttctgtcgatcaccggtcacaaaccgctttccatacataaagctcctttcctataatcggatagtaccaatataccatagtgcaatatatcgttaacgaaaaaggagcccgctcgcccgaactcctttttgaatcgattctttcttcagagccttacttgtcgtagagggtccactctttacggacgtcgcgttcagcctgacgcataaggcgttcggcgcggcgctttgcttcgcgctcgcgacacgccttaacttcgggaagcataaactcctggtagtacatgaaacatgcaaggcagatctcggccgttcccagaagaagcaggattacgttcatctcgaagaacaggaaactacctaccctgatctcacagacaagtgtcatgcatccaaacataaatacgacagcgtcgttcatgatacgaatcttctcaatatgcgtatacgttctcggggcgcaatgcttaccgttcatcatgggttcctttctcccgttcgcttaacgtaaggttagtataccatagtaccctagtactattgcagaaaaagttgaaaatcatacttgataactctccgcaacaaaccttgaacgtcacgagcaagcgatgcgaacggcgatttgcttacaatacgctattcatgcggtgcctgacggcacctatgatccgctccctacggtcgctgattgatttctaaaaaaaggggatgcatttctgcttccccttcacaagctaggtcaaatatgtacgtagtgaaacgcaccaacttcaccctaccgtgtcgcatcctagctaatcgaaccgtcttcgagaacaaacccgatcggtttgcgcaaggagttgtctacgatgatattcgggtagtgtcgaatgtcgttgtagacactcccgacaagattatcgatcgcccacttgaccaaaaccggttcatatccattcagttcgcagaaagcttcccgcgccaacttgctctcaaaagcaaccgcgcaatagtgcttcccatcgccatctaaatccttgacagcgaaaaaagtcttctgtgccatattgtctcttttctccaaactatcaagcgccagacaccagatactttagcgccgggcacttggtgcttaactacgcgatgattcgttcctcaaggtttttgcgcatctcgacattgaacgacttgagcgcttcttcctcatcaccgccgttctcaagatactcgatcgacaggttgtccctagcgacaaccataagatcgtcgagaaggatagaaatcaactcctcacgactcacggaatctggggtgaagccatcgaacatggtttccaagaaaatgcgcttatcggacatggacataaccctttctgtaaaccgcctaacgtaaggctatcgtaccacaataccgtagtacgaccaacgagaatgagaaatagtttaaacaaaaaggacgaccgtcaccgatcgcccttcaagatctttattttacggactctgctgcatttgcaaacagctaggaaatgtcatattcaccctgcgcgatgcttcctgcgggaacatggatgcgtatctcgcactttgagaactctcgtcgatcgcgtgtccactcacctgctataggaaactcgtaggtttcacggatgaccacatattgatcgactacttcgaccctcgcatcatcggcttccgcatcctcatacactaccgcattatcaaccgggtaactcatcctccgatagccaccgtcatcctgcttcaccatcaggacatactcatcctcctcggtaagatatccgaaagaaagtgctgcgttgccgttaagacgagaatccgttttaagcgtagcaagggaatgagcctcagcgacctcgccctcctcactgaccaatttaagacttgtcggaaaaagtgactgaaataggcttaagattgctacgcttatgacgataatcaacccgatatacaatccgcctcgcctggatgatgagtccacggactgtaaggcaagtctaaaactgaagaggctaagaacgaaaataagtccaatcgctatgaacttaatccaattgaccacatcaacctccctttcctttcgttaaacgccgcatacctcgtatcctgccgatcgcaggacattaacgatttcttcgaaagtccccgagtcggaacatgaaatctttcttcccactggatcggcatgacatgttctcggagcaccgtcgatacttttgccgctctcacggctcctgactgcccgccattcatttcggagcatcttcgtactcaaaccggcatcgatcatttcatacatcaactcgtcgccacgcgaagggtcgattttggcaatcttacgcacgaggtcaagatttagctcagagagatgttctccttccgcaagactcgggacatctgattttccgtctgcccatttcttgtagaaatcgcctgcgcttttgcggtgccacaacaagctctccgatatgccgcatcgtgccgcctcgtctttaagccaagcggaaaatgaattgtattccggtctgtacagctcggcttccgacacatgctccatcagtgcgtacacctcgacccatgatcggcctccctgcttgaaaagacccataagctcgtcatgaatggaggaagtgcagggctcctccgatccgacagacatccgtttcgagtcctcacgatatttcaactcgaaccggatccagctgtcagatggaatagaggtgacctgttcgagctgacaggcgatttcccttccgatggcttcctttcccgtcagaagatcttcaatctcggcaacagaaacgcccagctctaccgcaaactccccaacggacatcccgttgccttcgatccactcctgtagatactcaccgggcgcgaccgcaaaattcgtccccatcactacatcctttcttgtttacgcgtaggtatagtataccatagtacagtagtatcggctcgcgccataaaaagagaacctgccatcgattgctaaatccaattacagcagcacttgcttcgaaatgggacgaccgttccgatcgcccgcaacagaagcctaatcaaaatggtgaaaatcatgctcaatattcagcgcgttgagcaaattgactaaagcatcattgtatccgttgacgtaaccggattcgtacggacttaatccggcgctgtcaagatcgacattggcgttgatcaggcgctccactgctttccaaactgtattttcggtaaacatatcagtgcctttctctgtgcttaacgtgcttaaagtataccacaatatcacggtactatcgctctaaataatagacgctcagcctgtctgctaacaactcgatgatcatctatgaaagaaacggagccgctttacccttcccataatggagatcggagggttcggtggcttcgataggcaacacgctccgtgattgattttcttcattttcctcctgtctccatcatttgccgccgcggtcacgcaaagcgtgaaccgtcggctgggatcttttggagcaagtaggcgagttttcgacaatttcaatggcgcggagagtccctgggtgaggctcatagcgctgttggatttgtcggaaactcgccccctgtccgcgctagcggactcgaccaaaaatcggcatcgccgatacaaagaagggcggccgttatcggtcgccctttcctcgacaggctagaaaaccattccccattcccctccttcctcgcctacccacgtgagataagacccttcctcgataacgggcttcaaggcgttgagaaaagtttcctcgcaccccgtcttgtcgtcatacgacaatccggaaatgtttccggcatcgtcaaattcgaccccgaaaccgaccatttcgagaacttcaacaagattgccgcacagctcgtcatagttccaaggcatccacgagaaccagacgtctggattgccggcacacgacttggaatctgcaggcttaggcgtcgggtcgccgccgaagttcccgccgtgcttgaggtagtcgtgcctgttgaggtcgcagacgatttcatagccgcgttcgaaattctccttcttaatcttgaagttcgaagcggtttcctcgatgcgaaggtaataacccatttcagttcctttctcccgttcgcttaacgttcctatagtataccatagtggtcaggggtgcattgctgagaaaactggtattcctgaaaagatttccctgttcaggtcgctaaaaccgaccttccttttctctggtgtaccttttaagattttcaagtgaattacggatggtgcgcgcggtcacgcgaagcgtgggccgtcggctgggggctttcggagtaagtcgacgagttttcgacaatttcaatggcgcggagagtccctgggtgaggctcgtagcgctgttggatttgtcggaaactcgccccctgtccgcggcagcggactcaccaaaaatcggcatcgccgatacaaaaatgggcgaccgttaccgatcgccctcagatttctctttaatcttccttacggtaaagtatgaacggatgcatcgctacttccagctcgatctcactctcctgttcatccgtaagctctatatctccgttctcgactgtgacctctatatcaggatcgctaccataaacggcagcaatggaaccgttcacaagctcaataacaacgctaggcatttatttcccctcaatccatcaataaaaatagcgcccataatctgggcgctagcggtcactacgcctcttcatcgtcttgatggtcggcacggttcatctgcttgacaatctcttccaccgtgccatgggcaatgacgtcaagaggaaaacacgccaccatacgacatggataatacccccgatcttcctcacatccgtaacggttcgtctcgtcaggcttgtgctgaaaaccacaatagaattcgagctgatccgtgtctaaattgacaatatatgcgtactcacagaacagcgaatccttaatgaaagacaagttgtcaatcatgtagaccttcgatccgctatcaataaagggcaaccaattctcgggacaaccttggtttggacgcaaagtccaataccagtcgccaccatcgacacccaaatcgtgcgccatgcaatactcgatctgcttcggggtcggcttggcatcctcagacaccagctcaatatggtcaaacagggagttcattccgtccctacctgcgcatttgcaaaactcgacaatcttcttcccaagcgaatcgggatagctgccaagatggttgtaggtcaacttgtcgatcccgttcttatggaatccgtacagaccgcgcgtacccattgttggttcctttctgttggggcttaacgtgatactatcataccacaatacgacagcgccaccttggtaaaatcgcaaaattgaataactttccccgtactgaaaagggcgcctgcaaaattgcagacgcccagcctatccacttattctatgtatgaatcgatcggttcaaactcccaaagagcgatacatcccccctcttcctccataacacgatctaagaggatttccaatgattcatgcgaccgataaaacttctgcaatacaccagtcaaccatttggggtctgcatcatcatgcccgtcaccgatttgttcaagcagtgcttcattttcaatgccgaaagtatcaacgtgatactgaccaactagttccccacggttcgtacagtaaaaacagcagcctggttcctcggcatcgtaatgatattcaaaagttttctcgggaaaggcatggttcaccccacgtacaatcgctcccagttgcggtacccatgcgctatacacaatacaatgaactttcgtcccctcagcccacacatcctctaacgtacctcgacaactgacatccgaatactttggaaacgcgttggaattaacggctatattcccgagccagctatcaccgaatccgttttctactccgcattcatgacaccaagattcaatcttatccgagactttcttggctaacctttcggttcccgtctcgatctcaagagaagtgctgcaccagttcggcatcttcgggttcctttctcccgttcgcttaacgttcctacagtataccatagtaccgtagtacaactaacgagaatgagaaatagcccaaacaaaaagggcgaccgttcccgatcgccccatgcaaatcttattccatgttatgaatgagttcccgcgcagcggtttgatatgcgtccgctttcgccgcataaatagccgctttcattttattctcttcacgtgcagcatccgttgcgtattcttccgcgagccattcaaaatactttatctgctcttctttagtacgcatggtctttccttccgttaagaacattcttttaaatagacggagcgatgcttccatttccgaacatcgccccgtctacactgcggtcgttactcgaacgcatgaacgcgcatgaactcgacctcttcgatgatgatttcgatatttgaacgatgctgaccgtccttcgtctcccactggctatagcgaaggcttccctcgatcacgaccttatcccccttggcaagaagttcgccaagctgctcgccacgcgtgccgaacatggtgcaattgaagaagttggggaactcttcccactcacccgtctcggggttgcggcggcggtcgttcacggcaatgccaaacgacatgacgggcttgccgctcgcggtcgtgcgaacctcgggatcacgcgtgagattgccggaaacggtgacgtggttgatagacatttcgggttcctttctcccattcgtttaacgttcctatagtataccatagtaccgtagcactaagaccgtaaataccaaattagcctgaataaatagacaatccatcaggcttataatccacctgacggctgctcgccgagcttaacaatcattttctcagccagatcatccttaacatgagaaagaacacagtgaatttccgattcattgtacccaggtgcaacacaggtttgattttcgtagcttgtaatacagccataccgctccccaagtgtaaagagatctccatcaggtttgcttttcatcttgaaaactcgaacgggagcgttctcattgtaacgcgcattcacggatgcaaaatttgcatcaagtagcatttgtccaactttctgactgcttgtcgcagcgctatagaaagttccatcattttcatcgtgcagaccagccgccccatactctgttccagccatcgcacaaacaatcgccgaaatcgtaagatctgaaacaatatcgcaactcatattcaaatctctttctcccgcccgcttaacatgagactactataccataataccgtagtaccagtaacggtaaaatgatcttcgtgaacaagatttccatgctcaggtcgctaaaaccgaccttccgtctccttgatgtctctttgaaggctttcgtgtaattgcgtttgtcgccgtggtcacgcgaagcgtgagccgtcggctgtggtctttcggagtaagtcggcgagttttcgacaatttcaatggcgcggagagtccctgcgtgaggctcgtagcgctgttggatttgtcggaaactcgccccctgtccgcgtcagcggactcgcaaaaaaactgggctcctattcggatcgcccagcataattaccaactatatgtaggcaaagacggcagtacctctgcgtcccgatcgagacccactaaattgcaattctccttatccgctaacctgaaaatgtcctgtaggcagcctgggatgtccttcccatagacatcttcccaatagagaataatccacccatagcttttcgggcagacaactacctctccctgtttctcgaacttctccggattagcgagaaacagtctccccattgcgcttagatgcgaggtcgaaagatcgagatacttgcaaactcccataatatgaaaacctcctatgaacataatcgggtagaggggcgatcccctctacccttatatcagttaggctacttcggcgattcggtctcccttgccgtaaccgtatccatcctcagctcctgcatcatggatggatgtatcttgcgagacgatatagcgctgcttcggctccgtcttaatgtcatgctgttcgttaatgaaacgggtgacactctcgggaacgacaaccgcaagcgcgaaagattcgtccgccgccacctgctcgccgtaagcctgtttcaaaccctcgacaaaaccgagacaatagctgttcttgcttccgctttgctttccgatacgcactcccgtctcatggaaacggcgctccacatatgacgtaaagcacctctcgattgcatgcctagtggcacgaaaacagcctgccgcgaccacgctatcctctgcttcgccaacgaaaacaacctgcttgctcgtaatcttttgacgattcgtccaaaaatcacgctcatggcgtacatgaaaataggactcgcaacgatagttgctggcgatgacatgcgccaacgccttcacccagatcgccacgcgcttaccgacatcttcgcccgtctcattgatctcgggtgcatcatcggataatgaaatctcgtcaagcgtcatgtcgttggctacaagaagacgctgaagcgcaagggatgccgctcgtgcttcgccctccgttgtggctccgtcaatcatagcgaggatcttcttaatcttgtcgttcaccgttgccatttcgggttcctttctcccgtccgcttaacgtggtttaagtatatcatagtaccgtagtactaagaccgtaaatagcaaattgaaccaaaataaataggcacccaaccggatgcctatttaagaaccttatcattcaagcgtgccaacgaaacgatcatcggtattggaaacgagatgaatctcattgccctttaccgcaacacgaaccatgcggtgcatgaaccgcttccgtgtgctgtcccatctggtaacgcacacaatagcccgatcgccgctaccaaagtccccgtcctcgcaaacggcgatagctgcttcctcgtcactgtagcaataatcgagttcaatatcttcctctcgcccatccgcacgataaatgtgtgcaaacatattgtctccgttctatatatcactggcctatatattgctatacgggttcttcgtatccaatagtaaagggtgtttgcagccaaccacacctcatttcaactactcggcgatatggtcaacaagatccccgatgctctcaatcgccaagggcgtgtcaagcgttcccatcgttatgtcatagaaatagaaatctacatactcgccactatccaccgcgtcaagaatatgacgcgcaagaaacagcctatcgttttcgatctcactaatcgcatatctcaagagggtttcacgactgcaaacgtcatactccccagctgccatttccgatgcgatctcgctaagtggcttgccttcatcaatcatagcgcggagttctgcttctgtcatttcgggttcctttctcccgttcgcttaacgttcctacagtataccgtagtaccgtagtaccgagatcgtaaatagcaaattgaccaaaataaataggcacccaatcggatgcctatttaagaaccttattattcaagcgtgccaacaaaaagatcgagtgtaatggaaacaaaatgaatctcgccccctgtccgcgacagcggactcgatggaaactcgccagctcgaattacccttctacagaaatacggtgctgacgggacaattcaatcgtcctgtcagcaccgcttgactaaaactcttaaaaatcgtagacaccctgatgaagtgcctgtttcacggaacgcctagcgcggcgcttttctttacgcttctcggctgcaattcgactggtatgccccgcaccgacaaaatccgtgcaaccgtaaaccccagcgaagcccttggcgttgatcgcagtcttgcgcttgattacgtccttcatgatgtaactccgtctctaggaaatcgcgtaaaccgaggaactttcatacacaacaggatccgtcctaacaggaaataactgctggacgctcagggggcggcaatacgtccattcgacaagaatgaccttactcgaatgatcgcaactctttcccgcaacctcgatcgcgcgtctcttcgaactgaacgccgcgtgccttgccttgccattaccgagatattcatcaaccagccaagtgacatccatcgtaactcccgtgttcgaattggtattatatggtagtactataatactacagcggcatagtactgtcgctgagaaaccaaagttttgatgtgaaaagcccttgcacgcgatccgccgccttgaaaaataaaaacggcacctcgctttccgaaatgccgtccatcgttacactatcagccctttttcacgagcgcagacaataccatatgcctttccttcccatcaagttccctctcggcaacctcgcggaactcctcggtataatccggatcgcccttctcacgccagtcctccggcacttcactccactcgcactcaatctcttctgacgtgccatcatcaacatagcgataaaacccgtccgtacccttcaagacactcattacctcgtcaagatccgctccctctgccatatccagatcaaaaaaccacgtccgcgtctcggaatacatcacgctttttttcatttcgggttcctttctcccgcccgcttaacgtaaggttagtataccacagtaccatagtactacggataaaataagatttttccacaaaaaagggcgaccgtcaccgatcgcccttttcctatgcagcatctaaaatgattccctccccgtaatcaatcaccatacaggcaaacggacgatcggaatcatagttatcagtcacgccccaacaattgaagcatagcccatcttcgtccggaccgaagaaaagcgcatcctctacaagcgcttctatatcgggaagctctgtatcatctgccgtgtccttcgcggcatcaaggatctcctttctcttcgcagcacactcagaaataaactgcatcgcagataaaaagaacgactccgtatatccgattaccctttccatgcatcagcctttcacccgaaacctaccgttagatgaaacagcctgttaagctgccctatccaatgtctacctattcgtccctgtgaccatgctcaaggcagaaatccatcaccttatctaaggttgcgatctcctccgaccaatcgtcaccgtactcctcattctcggatagaaatgtaattgtcgagcgaatcgcatcaaggttgatttcgttgacgtcaatcatgttcgggttcctttctcccgttcgcttaacgtaataccaccgtactacgacattactgtatcaaaatcgaaaataaaatagggacgttcccatcaaaccgtccctatactgatcttatctaccactcggcgtaataggcgggatgctgcatgacaccgccgatgttctcactgcgtctcacaatcgtgaatcccctaccttcaagcacggccaatgcagcatgggcatttgagcagcaatccgtatagcacagcaagacacctcgatcaccatcttccgcggcctgcttaatctccttctcaaaccttgaaatataagggttctcagaacgtgaagctatgctccttgcgtccctagcgttaaactcgccattccctgtagcttcaattgccatttcgggttcctttctcccgttcgtttaacgttcctacagtataccatagtaccatagtataatcatcgagaatgaaaaatagcttaaccaaaaagggcgatcgagaacggtcgcccttcaatgtctttatatcaatccgataacgccttatcgcatttcataagaacgcgttaaagcgcacaggccagatcgcctactcgcttttagcagcagccgatttaacgaaaaatggaactggaatcggctcttctgtatctgctcgatacccgtaagtcacaaacgcggggaagttacactcaaggtagtttgcactctccccctcaatcatggcgataaggtcgatcaccgcatcgttttcgtcaatccagaaaatcctgatgccgtgaaagtcctcactctcatcgccctcgaaaatcccgatacgtccagcaggcgtgtcgatagcgtaaacaggcttgcacatatcaattcctttctctgtgcttaacgtacctacagtataccatagtactgtagtataactatcgacaatggtgatttctcagaaaagacttccatcccgaccgagaatcgaccctcttcatctccccgagttctctttaatgccgttccaagtagattgcggatggtgcgcgcggtcacgcgaagcgtgagccgtcggctggggtcttttggagtaagtcggcgagttttcgacaatttcaatggcgcggagagtccctgggtgaggctcgtagcgctgttggatttgtcggaaactcgccccctgtccgcgctagcggactcaataaaaagtatcggacttgccgatacgcatttttcaaaggctcaaaataggggaaacagctcattctgggcggtttcccctatgcttaaatcactcggcaacgcctacacctaaacgatcggcaagctcgctgtaagtacctttccaagagcctccggaatcaattagattgataaagaccaacggatcggacacctcgcccgattcgtcaagcggttgagcaataccaacgcccagactcttagatgccgccagagtcgcatgtacaaaacgtggatcgacgttcgcgacctcgacttctccattgtcggcaaaggcccttgcaagaagctccggattgccaaaatcctcaatttcaaccgcgccgtcctcatactcccatcgaaaccagctacccggctctacatacggcttcaggtctgagagtaaatcctccgtaccgtaaggatgtttttcgtatggcagatacagtcccaccagactctcgcactcaaaggtcggctcaaacccatgactacagatcagctcccggaacgacccatcgaagccaagtttacaaagaatactgttgtagcgggaccagtcgatcttgacagttccctctccgcccataaagcatcccatttcatttcctttcccttgtggggaggcgcttacagctactagtatagcatagtaccgtagtactacgtatagaaatcctatccatcctttagttctttttgaatctgccgcttacgtacataaatcaattgacgaatactctcaggcatatttaagaattgaggggagattccgaaaaactccgccatgaccacagccgcgaatgcattcgcatcaacttcgagcggctgggcgttgtactcgtcaatatccaattgatcgcttgtacggtagtcgtgcaaacttcgatcgttttccagctgatatgcatgacgaagctcatgcgctatcgcgaaaaatagctcaggcgtgacgcctatatcatttcgaatcaaaatgccgtcaggggtcagtgctgcaatttgcgtacttgtccgtaactgtttgaccggaacaaaacgtatggcaggcgcggcaatctttaaaatcgcactgacttccctggcgaactttatacagatttgtctcttgtccatattttaaaatctcctccatagtacgataataccacagattttaaaataaaggaactccgctttaggctacaggcacatgaacaaccctaagagggttggagtatgatccggcaagcgaaaagctctggcgggttccacgactctttccgtcccaaaacgcgatgacaccgcggttttcatgggtggaaatatattcgtgcatcgcacgattcctgatataccccgcacgcctgccgtacgtatcccagtcagcagggaactccatatagcaatatccccgatccacggcataccgtttcgccaaggcgtctgcacctcgcgcaccgccggaaacaataacaacgcttccccaattccttaaaaggagatcgcatttcgctacaaacaattcgtaatcggaaaaagacctcgaaccgacaatcaagcagtagaacgtctccacatcagacatttcagaccacctttaaacggcgttgacaccatagggccacaattgctaaaaaggggcacctcgcatagaggtgccctgtaccaatcaacgtatcaacctaaccgatcagaacgcactcgggaacaccataataagcgcgatcctcttcggcaatgacaccgaccactttgtccatcggattgtcgcccccgacctccttcggcacaaaaacacgggggacatagacgccgtttccctcggaatcgacagacaggccaacaggcatcttggcaatacccttgtcggcagacatcagctgctcaagcctgattgccaattccttaaccgtcatggggcggatcgaaccgtccgaaagatcgattgtataactgggtgtatcaattgtctggctcatattcgggttcctttctcccgttcgtttaacgttcctacagtataccatagtactgtagtacaactaacgagaatgagaggtatcttaaacaaaaaaggacaaccaaaattggctatcctttagaatcaccgttctatatttcatacacaatagaatcaagccacttagccacagattcgaatgtctctttcgattcgtcccaaggaacaattacaagaagttgcgaatcgacaccgccgtcagaccagctttgagtgtccttcccgaaaagcgtatcaaactcggggtattctctagaaatgtagttagctttcttctcgacacgttttacaagctccccatatgtgatgccgagcgattcggcaaaatccctatcgtaaatagattccaatgcgatgccatagcgccctttgagttctacaagataacagctgaccagatgaccatcagtccacagctcatttaaagcatgaagcaattcatcaggcagatcatcctcaccgatctcgccattatgccgcaggtcggcagtagcatttgaccaaaatataaggtcattatcaagggtactctcatatttgtaaaacatgcgctttccttccgtccgcttgacgtggttaaagtataccatagtaccgtaatacaactaacgagaatggcgatttctctgaaacgatctccatccgaccgagaatcgactctcttaatctctctgagttttctcttacaccgttcccagtggattgtggatggtgcgcgtggtcacgcggagcgtgagccatcggctgttgtccttacaacgaagtaggcaggttttcgacaatttcaatggcgcggagagtccctgggtgaggctcgtagcgctgttggatttgtcggaaacctgcccctgtccgcgctagcggacccattaaaaagcattggacttgccgatgcggattcttcaaagaaatcgaaatgagggatgtgaaatgccttccggtgatcaaattcgcaagcgtttgcgaatttgatggctgcttgcatttagcttcctaactggtatttaggcatggaaaaggctcctgtccaaaggacaagagccttttccataggagtaaagatgcctagagatattttagcacaccccgaacttctcccattcctcaccccagtccagcgcaccgtaaagatcattccaggcgacgagattcacgttcagacgctctttgttgaagagtgggccgcacacacggtcaaccagacccttatcactccaaaaagcgatcgcatcctcgacatccgagtcatacaacccgagtagctttgcgatatcatgcggacaatacgggcaaaaatctgccgcgaagctccacgcagaaatgaatccaaggacaaggcgactgaccagagatgaatccgaatatatctcaccggcccgcatggcaaccaagggaatcggcggacaaaaagcctcatcgatatcagaatttaccttagcctgcctgactgtggcggcggcatcaaagatatgatcgcacatctccaaatcaagaataagatatgaatccttcttgcaaacgagcctgcgatcaagaagctctttaaccgaagattccactacagcaccgtccatatgcaagtactctgaaatgtatgcaacatcaactggaatcggtgcattgtcactggcaatcaacgacatgacaaggcacatctcatcggtagggagacctagctttagcgtccatgtcggaaatgaatatccatcgctgttaaggagtgcttccatagcctcttcgtcagtcattttttctccttcaattcagtcaattaggctttcgacatctgtgcgacaggctcattgaactcggctatgcacttgcagatgccgctcgcactgtacagtttcccgagtgccttatcatagccatagtcctccttcaagccctcaaaaatcttcccggcctccaccctcgcatgggcggcatcggtcgctgccaccgccgtcacgtaattcttgcttcccattttcccgggaacggtgtaatcgacctcgaatcgatacagcatcattcttattcccttctctcgtggtgccgtaataccaatataccacagtagtatgctaagtgatcgctcaatcgaaaatgccttgtaatactagagaaaaaattacccaaatttttcgatgatactaaagtcgaatcgtgttatagtcttattgtcgcttaacgaggaggcaccacctgattcctttccaggtggtgcctccgcctttttatagccagataatcaaatatgtcttccgaaggctttgcgctttacatagagcgttcgtcatcgttgtaggcggaaaacatcatgtccttttccgccatccagccgatgcggactgcacctctcttgccgtctcgacagatcgaaaggaggtgaaacctatgggtaacagcgacaaggacttcgagaagtcaaaccaatgcgcgtttgacgcctactgcaaagtaatcctcagaaatgaagcgagggacgcatacgaccagcgtaaacgcaaactgaaacgcgaacagctcttcggagagatgtcgcctgaagagctgaacaagctcatcacgacagaccggtatttccaattcgaacgggatatcgtggaagacggtttgcatttcattgtgtgcgatcagggcgtatacgatgcgctcatgacccttcccagagcaaaaagaaagatcgtccttctatcctacttcggagagatgaacgaccgcgaaatcggcgacgcgctcggcaccggacgcgccaatgtccaataccatcgctcgcgtgcgctcgcaatgatgcgaaagatgctcgaacaagaaagtgaggaatactgatgagcaggcgaaaaaacaaacttgttccatttgaaaccatcgtccttgcaacgcagggcgacccacaggcattggaacaggttatacggcattacagaccgtacatactctcactctgccgccgggaatatattgcggaaaacggcaacgtttccatcgtatgcgacaacgaactgaaactgcgacttgaagcgaagctaatggcaaaaatcctgctgttcgatatcagagagagaggacatataaaacgtaacacgtaaatcaaaatcgaaacacgactcttaaaacctaaagatagcaggggagaccgcgaaccggtctccccttggttacgttgtacaacctaatcccgctgtggtataatactaccatacgacaatataatcacggaggcaatccaatggagaaaaataccaaaacgttcgctttggaagacgatcctaaaattcctgaaatgccgaaaagcgaggatgagcaacgtaggtaaaatgaagactatgccagaaatctcggacttgatgtgatcgacccgataggggactgaatcgcggaacagccgactggacatggtaagggctggtagcgtataaccgctaccagccctttcgtctacctatcttgcctggaggcgggcaatcaacgcttcctgcaagactttggaaaaattgattccgcgttcctcgcatgatgcattcagccacccaggaatcgtcaatgtcttctttaccgacctctccccgtatttcctctcgaacgccttgagatcgatgtcgaccatattgacaatcgctccatcctcctccgcaatgacatcctcgatggaggaagccaccggaagaacattgccttccttcaattcattgaagagatactgcccacatgcctcctgggccatcgcaaacgcatccgcaaaatcatttccgtaggtcgccaaatcattcagatctggaaaaataaccgaatagcgaccgtccacttctctatagaacaccgctggatagatatagcacataccgtttcctccttaatcaaaaactacttcagccccgcctgcctcagcacggaaatcgcgaccctcaacggaatgtcgccgccatgcctcggtatcgtaaccttccctttcttcaacggatgccggtactggtagtgtgatcctttcacatcacaccgaatccagccatccgcgacaatcagcctttcaagctcccgaaacctcatcttccgtttaccctttctctaattatagcacgtgtaatacgtggtgtaaataccatactactacggtacgaaactactaccgataacaccgatcttttgcaaggctggacgctttttgcgcgtcctgcctgctggtttgtgatatatcattttctgtgcattccgactacgggttactggtatctcggtagcatagtaccgtaatgctattcagatttaagagtcttcacgaacttcgccacaatactctggctggattccgccatgtcatcgaggagttttgacgcctccactttgtcgagcctgccgacctcgatcaccgtgtcggccgccctagaatatgcgtcgagcgcggattcgattgcgaacttggctctcgcaatagctccggtcagctccctgttctcgattgcctcagtcacttggcgtttggcggcatcgatctgtttccgtgcgacgtctgcaacggctttcgccgccctctccttttcctcaagttcggcacgttcctttgcaaacttggcattcatctcctcttcggctttccgtcgggcctcggtaacctgtcgatctctctgtccattcagttcgtcaatctgtttaagcagttccgactgcttttcggcggcggcatcgagtttcttccgctcctcttcaagggcaataccgattgcctctttctgccgcttctggttggatttctcggcctctgccgcccgtttctctaatgcctcgatctgagcagcaaccttggctttctcggcagtcaatttcgccatttgagtatccttttgtttcagcgcgtctgcgaacttagcttccgcctcggctgcgttcctgtttgcaagctccttaacggctgtgaccttttccttctcctgtctcacctcctcctggagcctgcgcaatgccatctcaccggctttgcgttcctctgcaaatctcgcacgctcgtcttccggaaggtcaatcaaagccaaagcctgcgtgtaactcaaattcgcaagcgcttgcgatttctctgccaacccgttccgaccgtactcttgatagatcttcatgaagttgttcgccgtcctctggctgtaatcaaccctttccttaagccacgttccccacgttccgcgcttcaccatagctttcgcctcggtcagacgcctgccgatctcgattgagttgaacaggacgacctgtttcgtctgttccgtaatcatccggatctctgaaaccagcctatcctcccttgcagcatcctcatcggaaacatactggactgtctccgcactctccgtttcagtcatcatcggaacgacatttccccttgcgatcacctgggcctcgacctctacgtttttcttcgctcttcccatcttgttttcctcctatttttaaatgatttaggctgaacagcttgtctgttctgctgtgcctataccgggcatgaatgcaacgtagtggagcgagggcgcgaatcaagggcgaagtctttctgccagtttttacggagcatgcggaggaaaaagttgcagaaagatgcgcaggcacccttgatggtcaagcgcaggagcggcatagaatgccaatgcctcggataggcccagttcccgatcccagagggaactttcctttttccaaaaaggccggcgccgattgagcccgacatcttttaggagtactagcgtacggtagtatcaaaatgaagatttgcacttttagacaacgacgcgtaaatgtctgagaaaagaaaaaaaggagatcaaacaatgaagaatggaacaaccgtcatctgcacaaatatcttcaaggggaaaacggaggaagaaatcaagaagaggttcaacatttgtatagcgaaaatcatccaaagagaatcgcttgcttattcagaaacaggacagataacccaaatcgacaatactgtaaaacgatagtattataatactgaactgcaaacagacgacattccatcgtcccaaaggaggatggacaaatgcaaattgaaacaccacaggccgtcgcaatctactgtcgtctatcgaaggaagatctcgacgaaaacaaaatagataatctcagtagaagtatccaaaaccaaaaatcgatgcttaccgattttgccgaaatcaacggatggcaaattttcgatatttactgcgacgataatctttccggagttgcacgggaccgtcccgaattcaatagattgatacgagatgcctcgcttagaaagttcaatatcattctttgtaaaaaccaatcgcgctttaccagagacatggagctcgtggaaaaatacatccacggtctcttcccaatttggggtatccggttcgtcggcatggtagacggagcggatacatcggttaaaggcaacaaaaaagccaggcagatcaacggacttgtaaatcagtggtacctagagaacctatcagacaacataaaggctactttaaaacttaaaagaatcaggggaaaatacactggctctgtcctaccttacggatatcgtccggatccagacgatatcaactgttttatcattgatccagttgcggcttcagtcgtaaggcgaatttgggaaatgcacgccggaggcatcggggcgcctactatagctcgaacactaaatgaagaggggataccgaacccaacgtcttatgccaaattaacgggctactcatggcataatcgtccctcaagctcactttggtctgcaggttgcatatattcgatcctacataatgaaacatacctgggcacattgtgccaaggacgacaactcacacctgaaggccaatttcacagcaagaaaaatattccaaaagaccaatgggttcgcacagtgggccaccatccggcaatcattgacgatgagttattgcgtagagaacttaaagcaagaaaggaagccggagctcacaatcttcacgagcaaaaaaagaactttccaccaggcattttcggtaaggaagtccgttgtgcaagctgtggaaaaattcttacaaaaggaaaaactttacgtaaaacgggatacgaacgtacccttttctgcccgaccagaaaaaaaagcccttcgcactgcaaaggtgcattcatatccgagaagcatcttgaaagcgcaattctccatgagttgaagaatcttgccgataggtactccgatgatcgcgtccaaataggcatatgtcaggacgcgcagtccgccgatcttattcaggagaaaaacaggctgaaaaccgctgtcgagctcattgagaaggacatcacggcctacgagcagagaagccgcgatctatatctcaaacgcgctacagatggtatgtctattgacgattttaattctgcattaagcagaatcagaaacgacgtagacaagctcagattgaaatcgaaacgtgcttcgagcgaattactccatctgaatgaatcaatagcagctgaatccataagaatggaaacaattcttaaagccgccgactttaaccgcctagataagactaaggtttcgatgcttatagaatcagtctatgtacataaacgcgatccaaaatcaggaacgcaagcgatcgacataacttggaaattttagtccgcggttccaaactaaatatgacaataccacatagtagtactataatacttatgacggtcgttccatcaggaaggtggaacacttatgaaaacacaagacaacagagatcggatagctgcaatctatgtacggctttccgaagaagaccatgacaaggttcatgaaaccgacgacagtctctcgatccaaaatcaaaaatcaatgcttcttgaattcgcatcgaaacatggatggactgtctatgacatctataacgatgacgactatgccggtgcagacagatctcgcccagagttcaacaggttgattacggacgcacgggaaggtaaattcggtatcatcctgtgcaagacgcaagcacgattcacccgtgaaatggagctcgtggaaaaatacatccacggcctcttcccaatttggggtatccggttcgtcggcatggtagacggagcggatacatcggttaaaggcaacaaaaaagccaggcagatcaacggacttgtaaatgaatggtatctcgaagatatgtctgaaaacatcaagagttcccttgatgaccttcgcagaaaagggcaccatatcggtgcctgggtcagatatggttacatgaaagacccgaaccaaaaaggacatatcattcccgatccagttgccgccgccgtggtggaacgaattttcaagatgtaccttgaaggaaacagtagagcagacatcgcccgcatcttaaattcagaacaaatcccgccgccgggactatacaaaatccaacagggggataaatataaaaatgccttcatggcaggtgagtgggattcctgctctatttcgcgaatccttaaagaggaaatgtatatcggcaatatggttcaaggccgacaagcatccgaatcttataaaacaaaaaaacttcgaacgttgccaaaagaagattggattcgtgtcatcggaacacatgaagcgattatatcgctggaaacttggaatcaaacccaggcactactcgctgtcggagcgcgttcttttacacgatcggaggaaataggcctcttttcccgaaaagtttattgtggccattgcaacaaattgatgagaaccggaaggtcaaaaagaaaatctggtacgtactacaattacgtaatatgcgtcagaaggcaccctgaaatcaatccttgtcctgtacatgcggtctccaacgccttgatggaaaaaaccattctcgaccaattggatatcctcgcggccaaatacaaggatggctccttattttcagaaataatggatgaagaaagtactataggcattgaaataaaacgcttaaaagcagaacttgcccaacacaaaaagaaacttgttgaatacgagaccggtctcaaatgtctatatttagacaaagcatcaggaagtatctcaaattcagattatcaattcctatccagagagctgtcagctggaaaggaattggcagaacgtaaagtggatctttgcactgagaattacaataaaattcttcgctcgcaggaaatcttaagagaaaaagcaggtgtgctcgaatcctattcgcgtccgaaagaactcacgagaagtatggtggagactttcatcgaccatatcgtcatatgttcaagttctgatggtacttctaaacaagaaatcaaaatatattggaatttttaaaacatcctatgagaaatcctgcccgcatcggtcatttccggtgcaaatctcttctcaagtcgagtggagcagacgcaactgccgcgaaaaggcaggcaatcctggatctgaatacagaagaacaggatgactaaaaatttatcttgtcggtacatttgtgctgatgtataataaatcaggactaaaactcaggtagtttccccgaacaattgaagttcggtccgacacccgagttttagtccttttttatccttttatattctttttttgctctatactacaggcttccaacaaaccgctcaaatgctgccctgccttcttctgtctgcttataaacaccggcatcttccagcacctggttaaacacctgtccgatttcctcatggagaatgtccatgatattttctttcgtaatgtctgtatattttggaaggaattcttctacccagtctgcatgcttttcaagcacttcattgctgcggatgtcctttccttcaaggattgcatctgcaagctgttccatctcacttttcagtcttgacggcagcactgcaagtcccatcacctcgatcagaccaatattctctttcttgatgtgatgtaattttgcatgcggatggtaaacgccaagcgggtgttcttctgtcgtaatattatttctgagaacaagatccagctcaaaatacccatccctgattctggcgatcggagtgatcgtgttgtgcggttctccgttcgtctcggcaaagataaatgctgctttgtctgtataagatctccaacacattaaaatatggtcagctgcgctgatcagacgttctttgtctttgcactgcagacggataacagacattggccattttaccattccggcgcgcacatcttcataccccggaatcacatattctttaataaccggagcttttgccattgcaaattcatgatttccaccctggaaatgatcatggcttaggatcgatcctcctacgatcggaagatctgcattggaaccaacaaaataatgtggaaactggctgacaaaatccaacagctttgcaaaggttgcacgctcaattttcatcggcacatgctctccgttgaaaacgatgcagtgttcattgtaatatacatacggtgaatactggaatccccagtcttttccatcgatcctgaccggaatgatccggtgattctgtcttgccggatgattgacgcgaccggcgtagccttcattttccttacacagctggcatttcggataaccactctgtgtagcattttttgctgccgcgatcgctttcggatctttttccggtttggacagattgatggtgatctccatctccccatatggtgtctctgtgatccatttctgatcctttttaatccggtatcttcggatataatcactgtcctgactaagcttgtaaaaataatcggtcgcctttttcggtccttcctgatacagttcatagaatttatggcttaccatgctcggcagcgggaccagttttcccatgatttttgtatcaaacagatcccggtacacgattgaatctgcaatcagttctttttccactgcataatctgtaatctccttcagaatctgttccagctcctctgcacccctgcttcctggtgtctcctcgtaagactccagaccaagtgcctctaaaatctgattggtaacaaatattttatcttccggtgctacaagccccgtatctaatccatactgaaccagttctgtaattgcctgatcgatcatttttcttcctccaaatctttttgctcgtcttatatccatccattttcaatgcggcacatttttacaccgaatcctttatttattcagatagcaaactaaaatctgtatttatgtctaaccttgacagctagcatattttcgtttacgcgattactttcattccgccatatttacgaacctttaatacgtggcaggatccttctccaaatactgcatccaatgcttttctgtactcttctacaaaatcattcttcacaaatgcctgaatggttccggcaaatccgcctccatgcacacggcatactccatggtttccgagtacattttcgctgactgcaagggcaatggatactgcctggttctgcacgtcacggttagtatatacattctgaagatatttgaaagaggaatccccagatgctttgatcatattaaggaaatcttcaaatcttccttcgcgaagggatgcaacctgtgctgcaactctcgcattatcaccgaagaaatgcatagcccgaagcaccggacggtctccaagcttctcgcggagtaccgggatcgctgcaaaaaattctttttcatctacgtcacggaggacttcttttccaaaatatgttgcaatagctttcatatccgccggaatctgtgcataatccggtgtcagatcctgatgagaacctttggtatctacgatgcacagactgcatgcatgattttcaaaatctacatctactttttctacaaccggagcctttggatctttgaaatcaatgtggatcagtccaccaaccgcgcaggctgtctggtccatcagaccacttggctttccaaagtaaacattttcagaatactgaccaatctgtgcaatctctaccatgctgatctgcatatcgttgtaaagtccggaaacaatggttccaatgattgtttcaaatgcagcagacgaggaaagtcctgctccgatcagcacatcacttgtcacataagcattgaatccaccaatcttgtatccgcgttctttcagtcctgcaagtacgccacggatcagtccgatagatgtcccttcttctttgtcaaccttttctacatcattcgcatcgataacgatcatatcatatccttcagataccacacggacagtcatatcttcatttttatttacaattgcgatcgcatccagattaatagaggttgcaagcaccattccgtgctgatgatctgtatgatttccaccaacttcacttcgtcccggtgcgctgtatacttccacttctctgtccccatataatttctgatactctgccatcgcttttacatagcgttcttcctgatgtgcaatcacactttcatcaatataaatatcttttaatgtatcacggtacacgccctgtttcatttcttccataagttttgtaagctgtttcatcttcatttcctccaaatacattttcgattctgctttgataattgtattataaaatatatttagtaaatttgcaatatatatttactaaatatttcaataaatttactagtgaatttttgtacagttctacataattctttcactttccatttttttactcctctgttataatagaagaatcagaaattttttaacaagggggccgcttatggcaacaatcaaagatattgcttctgctgccggtgtttctgccgcagcagtttcacgtatactgaataatgatgagacgctcaatgtctcaccggaaacccgacagaaagtactggatactgcaagagagctgcattatgtaaagcgcggacgtccttctgtcaaatcactttttacccttgggatcattcagtggttctcttcccaacaggaactggaggataattattatcttctgatccgtcagggaattgaagattactgcctctcacacaatatccagattgtgcgtacctacaaaagcgacatcaattacatggacgttctgaaggatgtagactgtctgatctgtatcggcaaattcagtcaggaggaaatttcttatctgtatgagatgaattcgtgcatcctgttcctggatatgccggtaaacgatgaccggatttccacgatcattccggatttcggcgaagcagttacagaagctctggattatctgactgggatcgggcaccgggagattggtttctttaccggaaaagaatatatcggcgaaaatcatctctatccggattaccgaaaaaaagtctttattgattactgtgatgcacacgatttgatttatgagccttatatccaagagggtgtcttccaaatttcttccggttatgagatggcatgcaatctgatcaacggcggcaagctgccgacggcgatctttgcagcaagtgatccgatcgcttttggtgcgatcaaagcctttaccgaacacgggatccgtgttccggaggatatttccatcgtaggctttgatgatatcaatatggcacagttttctgctccaccgctgacaacggtcagtgcgccagcttatcatatgggaatgtacggagcttctattctgcagcatctcctgagggagcatccgggacctgcacttaagatcaaactgccgtgtaagctggttgtccggaattcgtgtaaagcgattgaaaaatagctccttatctgtctaaatataccaatgaattttatctaacatcaaaaagctcccatccagagaagaaatgagttataattagctcacatttctccggatgggagtttttttattaagcaatttatcagaaagcctttaggacatcaaataactttctaccagtcctgcactgactcttgataataagtcacattttcctgtaaaatttctattttcccatcttttacttccgcaattgataccgcacagttcttatgtaccccctgctgccagtacccggaaatcggcagacctttcatcaggctcagaatcccgcaaagtgctgcaccatgtgtggataaaagtacatttttatcctgaagctcttctttctgataaagctcttccagaaaattattcagacgtgcccgcacttcttcaaaggattcccctccttttggcggctgatacacttccggtgcattaaaaaagttgcgaaatcccggatccggaatattccatccctcttctctgcagcaaagtccctcaaattctccaaagctcatctcctggatccgcttatccggaacaatcggaacctccctgtcccccaggacgagccgtgccgtctctgccgcccttttcagcgggcttgtgtaacagaccgcaaatggaacatctgcgagtgccggagccgtctcttttgcaagtagttttccaaattcattcagcggaatatccacctgtccctgtaattttctttttttattccagtccgtctctccatgacggatcatatatattttcatctcttagcttcctcctgctatcattaaaaacacacgtatcctccgtgccagtcagcatagcgattggcacgggagttaacagtaacgattatagcacatttttcacctttcttccaccaaaaggcttgttattaaactttatgacagttataataaacgtagtacaaaaaaggagatacttgattatggagaaaattaccagtttcacaatagaccatttgaaacttgttcctgggctttacgtctcacgtaaggattttgccggcgaacaggtcattacaacctttgatatccgcatgaccaatccgaatgaagaaccggttatgaatactgcagaggttcacaccatcgaacatcttggtgcaaccttccttcgtaaccacagggactacgcatcaaaaacactttactttggaccaatgggatgccgtaccggcttctaccttcttcttgtaggtgattatgaatcaaaagatatcgttccactgatgaaagaaatgtttgcttttatcgcagacttcaatggggacgtaccgggagctgctgcaaaagactgcggaaactatctggacatgaaccttccgatggcaaattatatggcaaaaagatatctgactgaggttctggaaaatattacagaaaaacagctggtttatcctgaataagccttactatatgaacctgaaaatgggagccaaacataccatccattgattttcttcaaatgttcctgtatgtttgctcccattcctgttttcaatcaaaactctctatgatacactttcggaatttctaccagaacctctcttccgttgtaacataatctgccggaagatcaaattcttcggtctcaatttcttctacaatctgcatttcataagcagctgcgatccggcagatatctttccgtttttcaaaataacgatcataaaatccaccgccataaccgacacggttctttttttcatcaaaaacacttcccggcaggattgccagtgtagtctgcccttctccggcttcataaacagggcattcttttttcggctccaggatgccataagcccccttttccagatcctcaaaagaatgtatctgataaaactccatctcttttcccgctacccgtggcacatagaccttttttccaagctcccatgccttctcgatcagtgttccggttgccacctctccacgaaaatcaatatacgcaagaaggttatctgcatttttaaatgtctctgtctcttcaatgcgtctcatgatccgcaggctcttctcccgaacctcttcttttggaagtgcctgtctcattttcagaatttttgccctaatttccttttttctgtccatatttctcgcccagatttgtaatggatccatccttctccttgattgaaatgttattaagctgtccacgaagatttcttttgaatgcatctacatattcccgtctgagaatctgctgttcttttttctcttcctctgtcagtccttctgcttttgattttctatataattcattaatgcgttcaatttttgctgtctccatttttcttttgtcccttctttgttttcctatataatatgttatctttttaatcagctggaataattttccaggaacccataaagcttgtcttttccctctaaccgctttccctcccggatctcattctgcagttcttccggaagctcttcgacacggatattcgtatattcataaatacttgtctggtcgtccagataaacaatcacatatccgttgcggtttttcagataatacacctcttctttgtgtgcgccaccctgagtgctgactgtctgttctgtttcctgctgctccgtctgttctgtccttgcaatttctttcctgtaattataatctgcataatatgcataagataagatcgcaagaatcagaagagtccccgttaaaagaccaatatgatatcttgtttccataaggaacactcctttttctacaagtattggtctgcttggaggattttattcattatggggggatttttaggttgtgataccaaatcctccacagcttagtaatatctgcgttcttttaataaatggcattttttgcagactattacaatttggtgaccttttgggagactgaggagttctttttcggacatgccacccattttaaggagaacgactgcgtataccgctactgccacgatgagggcgatcagggttgcgattcttcctccgatgaaggtgtcaagtacgaaatgcactgcccatgccaaaattgccataacagctccggcgatagacggaataacaaaagtcttacggctctcctgaagatatccacatgcttcacggatatcatgtgcattcatgatacacatgcataaagagaacacaatcttacttccaatcagtgcataaatgccccatttgaacataacaagcataataaacagagatacaatatgtagtatcagggataccattgcattttttaccggttccatcatacggtccagaccctgaagcactgtattcgtaacggttgaaagtgaataaaataccagagaaattgctccgatcttcagcataattccctgtgttacattatctacattcggccacaggaaatccatgataggctgaccaagtgcaaagaatccaaatgcgcttggaatcgcgatcagcatcgtgtaacggataactgtataaatccggttatgtaacagtcttctgtcatgattctctgccgcgcttacaagccccgggatcacagatgatcccaatgcactcgcaacggcaagcggtacgttaaacagggtataatactgtcctaatttaccaagaagctctgcacagaccgcctcactagttccctgtgcacccatgatcttattgaacattgcactgtcaataacatttgcactgttataaattgttgtacttaaaatgatcggtgcgatcgtcagaatcaggatcttgaaaatcgcacggtaatcatccagttctttcgaggtatcccgcttcatctgccgcatcatcggcttgcggaatgccacatagcagaacagtaagaacagcagaccgatcagcgcaccggctactgtaccaagtgtacctcctgctgcggaataggctggtcccaaaaggttattcccctgcaccttagccatctgttttccattttccagaagaacggctgcacctacaacgctgacaatcgcattgagaagctgttcaatgatctgcgaaattgcagtcgggatcatcgttcccatcccctggaaatagccacgaaaaactgccataatcgcacagatcagaagtccgggagcaagcaccttcaaagaatagcagctcattttggctcccatcagatattctgcgatcgcctctgctccaaaaaatacgatcaccatgatcgtgacaccagatagcgtagctatgatcagtgatgccttcaataccctgaatgcatttttccgctctcctgccgccattttgagagacaccagctttgataccgcaaccggcagactgtaagacgaaatgatcagagcaatagaatacacctgaaatgccatatcataatagccctgtcctttaagccccataatattgagcatcgggatccggtatactgccccgatgatctttgtgataataccggctgccgcaaggatgcttccctgcatcagaaaactgccgccttttgattttttctttttacccatacgttaaaacctcatacttttatctatcttgtaattcccagcatctccagaacttcccgctgtttcttttccatcacgagccgttcttcatcttccatatggtcataacctaacaagtgcaacatactgtgcgcaataaggaaagcaaattcacgttctaccgaatgaccatattcttctgcctgctcctttgcgcgctctttggaaatcacaatattgccgagcatcagttctccggtctccggatcaaatgaactgtcatctgtatccagatatgcataatcagccggtgacgggaattccgtcatcggaaatgacaggacatcggttgcacggtcgattccgcgaaattccaggttcatctgtcggatctcctcattcatcgtaagaagaagttctacctgcgcctcgtatgggcacttctcataatccaggactgcatctgcaacttttgtcgccagttcttcataaggcagctttaaatccaatgctccctcatcctctaaaaatagtctcatcttgttcctcgtttctttctgtctctagtgtgggattttttctgttcctgcttttgctcgtattcctcgtacgctttaacaattcgctgtaccagcggatgtctgacaacatcccggctggtcagacggcaaatcgaaatatcttccagattcttgactacactcactgccacatcaagtccggatgtctgtcctgccggaaggtctttctgtgtagagtctccggtgatcacgactttggatccaaaaccaatacgtgtcaggaacatcttcatctgcgccggtgtggtattctgcgcctcatccagaataataaaagcgttgtcaagggttctgcctcgcatataggcaagaggcgcaacctcgatcagccctttttctgaattcttgataaagctttctgctcccatgatctgatagagtgcatcataaagtggtcttaaatatggatcgatcttgctctgcaaatctcccggcaaaaagccaagcttttctcctgcttcaattgccggacgtgtcagaatgatacgccccacttcattgcgtttgaacgccgtgattgccattgccatcgccagataagttttaccggttccggcagggccaaggccaaaggtaatcatcttttcccggatcgcatccacatatttcttctgtccgagcgtctttggtttgattggctttccctgaagtgtatgacagatcaggtctttatcaattgtcagaatatcttccgcgctgtcttccatcgtaagggacagggcatagtctacattctgctcctggatcgtgtttccgcgcctggaaagctcggtaagctgcgacaatacctgctgcgccctctctacattcttttcctctccaaggactttcacctttccatttcgcgcgatcagtgtaacatgtaaagctctctcaattttttttgcaaatatatcgaactggccaaacacatttttttcatgttcagccggtatgtctatcatggtctcaagaattcccataaatcagtttccttcctgctgtatattttctgcatctgccttcggcagttcatgtaccgttcctttttgtacaattccgaacggtccggataaaaccagtttcccctttgccgaataccggttcgtctccctgtatattttaacatcattctctgaaatttgaaccccttttttctctaatcgggcgcaaaacttctcaaaattataggacagaatttctcttgcttccctgtctgtataagaaatctcctcttttctgctctctttgctccgttcaactcttaccgagaccggaaatggaaaatgtctctccaaatacaggatatatctgcaggtcagcgcattatattccgggtaaggtaattcccgccttccaaaaagatacagccttcccggtgtttctatccagaacctccagctcttcttgccggtatctttccataccggatgcatcctgtcaagaatatctgtatacgcaaccgttgtctgtgctattatgtctgcatccgatacccggtactggtatcctgtcacctcatctgaatcattctttacttccacacttccactcacaaggatctctcctttttttacctcactgccttcccggacaagcggattcccttttcgtgtaatgatcttctgaatgatcccgtccgcttctgccacaatatccatcggcgcttccgcctcagcttctgtctgcagctccttccggtcaggattctccctgactttaatcttcagacaactcccatgaacataggctgaaacccagataatatcgtcgtattccatacgaatatctttttcaatccggtcacagtctacattcttttttgcaattccacaggcaattcctttttccgtcagaaaagaaagcaaaacctcatctgtccttgcaaggtttccatcaatctgaatcctccatataaaagaagaaagcagaaagatcagacagattgcgatgaccgatcctgtaaaaaaaagcttccgtccacggtatttatgtataaaaaacgggactcctcttttctggatgatccgtacctttgccctgctcttcctgaccattggtcgcagtctgcggaaatcccggacgcggatattcatctcatatgccccttttgccggtctcagattccagagaaaaatcccatgataacagcaaagatttaaaaaacgttccggtgaatatccttcgactctgatgcgcaggtatccggcaagattattcagaatatatcgcagcatcttcgtcatcccttcctaagaatactcaattttctctacctttccggtaatcttcatatcggttgttgtatagtagttgatctcaagtgatttccctgtgatgcgaatctgcccgctacgtacatttatacggatcagctgttcagtatattccagaattccacggtaattctctatattcacttcataatgccctgtaagagtcagaatcgggacacccagcaccacatccttcggcaaatttgctgcatctgccatgcgataccttcgtgtcccgtcttcttgttcggatctctgtctcatattgccgcatataccgttttgttgacagtgtatgcttcagaaccacataatattcctatgctgtataattgctgaattttcccgggagcagtcttcccgtacatgcatgaatttcgatctgacctttttctccggcaataaactttaataccgttgtctcatctgacggttccggtgtcggtctgccaatcgtaagcacattcttctttgcgtaagttgtaaaggtatattcactgcccggccgcagagaacagatgggtctgccatttaagaaaaatgcatcctgcccgccggtataaccgccctcttcttcgataatacggatcgttgccggagcaaaaaggcaatccggttcctgctgtggctgttcccagacattctgttgattatcccagccgttctgattccggttccatccattttgctgattattccagccgttctgattctggttccatccattttgctgattatcccagctgttctggttctggttccatccattttgctgattatcccagctgttctgattctggttccatccattttgctgattatcccagccattctggctctgattccatccacctgactgattattccatccatttggctggtcttctggtctgtaatttcccatcggtgctttttttgcaacccagtaagaagtgaaaccgccaattgcagctccgataattccaaaaaaatatgccccgtaaaatgcattatcacctgcattcaaaagctgcatcagccaggctccgacaaaagtaccggtaaattcaaggccaaaccacaatcccagtgtcaatgcacgatatttttttggattctgtcctctttctatcgcgtgctttccattcacacgccaaagccatataagacaaataatttctaacatttgttttccctctttcgcgcttctattttgttacataaaagtattatatcttcaatcgcagctgaaaacaatccattattctgtgaaaactttataaaatcgaacagactggctcctccatgatccggatatacaaaaaaatcgatcctacttttcctgtgattgtaagatcgatttttcatttctttgttatacttgaattctcgcggcggcatcctggctgatagcgaaccgcttctggtcagatgctataatcatcataccactggcatcattctggatcacatggatttcgctgccctctttgattttaaattcctttaatttttccagcacctccggtactccgaacatccatttgatcgtgtaccattttcccggaacagctgttgataatgcctgcatttttacaccttctttttttctcctttgactttactacagtatactcgctttcatattggttagtcaacggcaatgttttttagttattatatacacaattccatttaatagccatatttaacaattattttcagaattcaacttctgttttatcaccctcactataagctggttctggaagaaaatctgatcaaggcagacgagctggatgaagttctggatgcttatgcaatgaccgaacctaaagtcatactcataaaagaagcaatgtaacaagacaaaagtcccaggatctatcaactcattacccgtgataaatcctggggcttccttcatttaaaataccaccgtttcccctgttccaagtgcatgtaccatttcgccaagttcttttttcagaatcccgaatgcaatatttccggtacagtgaccggtatagatttcctctacgccaagccctttcaattcctgcgcagtttccacaacctcttcctctggtatggcaagtgtatccatgcccgagagcttcatcatatggaatccaccgacaaccgcatagaccttttgcccgccgagtgccatctgcacttctcgcacaatattgacaattcccccatgggaacagctattaaatatcaccagtccttttcccgtctcaaaaaccacactctgctcatgtgcaaaatcatctgcaataaactcttcaccgattttccggtacatgtgcgccctgcgtcccatctcatccagaccgccggtaaaatgcggcacgacccagacgcctttttcaacttcacagactgcatttaacggacggaaccgctctttataattttccagaagatgctgcggaattccaatatatttatcttttccttctgtccggtaaaagcagttttcagcagacgtctcctgcatatagaccgctgctttgtcattctccttaaaaaactcctcgaaaccgccactgtggtcataatgtgcatgggataaaaacgccgtatctactttcgaaagatcaatccccagctcctttgcattttctgcaaagagcgttgttgcgccagtatccagaaggtacgtctttccctcatattcgatataaaccgacagtccatgttctgcacaaagtctgcatctggaactgttttctactaatactaccatcttcatatgaatcagcctcttttctatttgtgatagggttctcccgacatgatccggtatccacggtaaatttgctctagcaggattacacgcatcagttggtgcggaaatgtcatttttgaaaaactaagtgcataatccgatttttccagaactgccttcccgatccctatggatccgccaatcacaaaaataatgtgactggttccctgaatgccaagtttttcaattttctctgaaaattcttcggaggtcagctgctttccgcctatctccagtgtaataagatatgcatcctcacggatatatttcaaaagacgttcggcctctttttgccggatcatttcctctgcattttcgctggcattgtccggtgtcttttcatccgccacctcaatgatctccagcttgcagtagcggctcagtctcttcgtatattccgcgatcgcatcccgcagatacttttcttttatttttccaaccgtcagtacggttatcttcatcctgttctttcctctctttcgctgtatcagtctgtacagttatgccctttcatacatataaagttcatgcagtgctcttgttgcacagatgtattttgcctgccctgtcatcggattttctttcttcgggaacacaccgaatacctgatcaaattccagtccctttgccatatagaaagtcgttactgtcacgcctttttcaaaggtactgctgtcccggtcaatacagtttaccggaagtccacggtttgaaagcatcctggtcattgtatacgcctcgtccatcgtctccgtcagaactgcggcggtctcatatttatccattccggcatctgcctcccggataagttcatttaacagttcctcatccgaatcaaatgtcttttcggtcactggtttgccatgacgctccagatattccagatccttttccccggtaaatttcgctgcatactctgcgatttcaatggtattccggtaacttttattcatgatgatcttgcggatcgtacgtccgaaaatctttggcaggaatgtcagtacatcctgcatctgactgtccagtgtctgcgcccggtcgccaaggatcgtcatccggcaggaaaacagctgggacagtaccacgtactgcaaatatgaataatcctgcatctcgtcgatcaccagatgcttgatatgcttatgtctggttcctccaagcatccggtatttgagataaagtaccggaaatacgtcttcatactggagttttctgttctcatacggaatttttgccagtgtctcatacccactgtcctccaaaaaccagttatatattttgtaaatatcacgggtgacatacatccggttgaatttctcccggatctcttctacttcatcttccggaagattccggttatacaatgtctcgtattcatccaccagatattccatcaccgcatccattcttgcaaggatcggaatatcctgaaatttgaaatagaacagatggatcagctcctcttcggttttttccagagtacggatcttaaccggcttaaaatccatcagctgatcttccagaactgccagaaagccttccatctctccgacaaatccggcagactgcttcttcaaatagctctcccggattcccatctccggaaaatggatcagcttctccagataatcataacggtcctcacagtccgatacgattcctttcaattctctgtacgcaaacagatcaaaactcatctcctggatattttcttctccaagctctggcagaatgtgggaaatataatccgcaaatacgctgttcggtgaaaggatcaggatatccgatgcttttaaatttttcctgtcgtgatacaaaagatatgcaatccggtgcagtgcaacggaggttttcccacttcctgcggctccctgaatgaccagaactttgtcctttacattccgaatgatctcattctgttctttctggatagtacggacaatattcttcagttgtacatccccgttacttccaagctcctgtttcaggatctcatcatcaatcttggtgtcactttcaaatgcataaaccatctttcctttcttgatcttatactgccatttggaagtaatctccccttcaatggttcctcccggtgcttcataagaagcctgtcctctgtcataatcataaaaaagaccgctcactggcgccctccagtcgtagatcagtggcgtcattcctgccttaggcgcaaaattgccgattccgatgtaaaaactttcgctttcttcttccccctcaaagagaaaatccactcttccgaaatatggggagtcgatcattttcttaaggcgctgttttttcatcagacgctcattgttcgcattaacttctccgagaagtgcctgctgattatcataattttcataaccatactcatccatttccgtatagttttcccaataataatcatgcatgctctcaatctgtttttctccttcaagaaacgatgcgttgatctcggtaatgcgtgtcttcagtttctcttcaacctcttccagaaaccgaatctcactgttcattgcgtcgctgttactcatattcaaaccctctcatgattacatcttccgatgatttgtgcaatctcttccggcatctttgcaatgtaatctgcaccggcactttgaagctccgcaagatctccatatccatacaggacaccgatcacctggatcccattctcctttgcaccgtagatatcattatttctgtcaccgaccataacgacctgatcgtaattctccctttccacgcccaggttatccaacgcataccggatcacatccgccttccggatcagagagccatccatcgtagccccgtaaatccctgcaaaatattttgcaaagtcaaatttgtccgcaatcctttttgcatactcttccggtttggaagtcgccactgcaagtatatatccttcatttttcaaggattccagcgtctccgcaagcccttcatacaccgaattctcaaaaatgcctttcaccgcataatattcccggtaatactttactccaagcagtgcctcttcctcagacatcccataatatttctccattgattccgtcaacggcggtccgataaatttctttaaagtatcccgctcaccaacctcccggttcattttattcagcgcatactccaccgaattcatgatccccggtcccgattccgtaatcgtcccatccaagtcaaataagatatatttatacttcataataaccctctttcacaaaataatatttttttattgtaccatttttgactcttcttgtctagaaaccctaatctccaaacctcctttaaaatcagccaaaacatacaaaccagcgtccgtttctccgccctttataaccgccagttttctcccctttgcacaacttgaattggaacgattattttttcaaagtggtctacacaacctatacaaaaaccgcagtccctatcaaaagaaactgcggtcataacccttatttatttgaaagatactcgtcgatacctcttgcaccagcttttccggctcccatagcaaggattactgtagctgcacctgttacggcatctccacctgcgtatacgccttctttagaagtctttccgtgttcttcgtctgcaacgatacatttccacttgttaacttccagtccttctgttgtagaagaaatcagcgggttcggtgatgttccgagtgacatgataactgtatcaacatcgatcacgaattcagaaccttcaaccggtacaggacgtcttcttcctgatgcgtccggttcaccaagttccatacgaacacatttgattccttttacccatccatcttcttcgaggatttctaccgggtttgtcagtaggtcgaactgtacaccttcttcttttgcgtgatgaacttcttctacacgggccggaagctcttcttcgctacgacgatatacgatatgaacttctgctccaagacgaagtgctgttcttgcagcatccattgctacgttaccaccaccaacaactgcaactttcttaccagctgcgatcggtgtatcataagaatcatcaaatgctttcataaggttacttcttgtcaggtattcatttgcagaaaatacaccgttggcattttcccccgggattcccatgaattttggaagtcctgctcctgatccgataaatactgcttcgaatccttcgtcttcaatcagcatatcgattgtagtagatttaccgattacaacgtttgtctcaaagtgaacaccaagctcttttacttttgcgatctcttttgcaacgactttctgttttggaagacggaattccggaataccatatacaagtactcccccgagttcatgaagtgcttcaaatacagttacatcatagccaagctttgcaaggtcgcctgcacaggtaagtcctgccggaccagaaccgataacggcaactttgtgtccgttcttcttgtcagctccaaccggtttgatgtcatgctccagagcgtaatcagcaacgaatctttccagcttaccgatagaaatagactctcctttgataccacggatacattttccttcgcactgtgattcctgcggacatacacgtccacaaacagcaggaagtgcagaagactgtccgataatcttatatgcttcttcgatattgccttcttttacttcatgaacgaatgcaggaatattgattcctacaggacatccctgaatacatttagcattcttacagttgatacaacggcttgcttcttccattgcctcttcctgattatatccgtaacatacttcttcaaaatttgttgcacgtaccttcggatcctgttctcttacaggtactttctttaatacgtctgccattattcgtcacctccgcaatgaccgcatccaccgtgatgtgtgtcaccttcctgtaatttcagcatagctctgccttcctgagtcttatacatctgctgtctcttcattgcttcatcaaagttaacgagatgtccgtcaaattccggtccgtctacacatgcaaatttgatttcatcacctacatggagacggcatgcgccacacatacctgttccgtctaccatgatcgggttcatgctgacgatagtcgggatttcgagtttctttgtgagcagacaaacgaatttcatcatgatcatcggtccgattgcaacacagacatcatacttgttaccttctgcaacaagtgcttcgatctttgttgttaccatacctgcatgtccgtatgtaccgtcatctgtacatgggtaataatttcctgcaacagcttccatctctttttcgagaatcagcatatcttttgtcttagaaccaacgataacatctacatcgatcccatgtgcgtgcatccatttaacctgcgggtatacaggggctgcaccaacaccgccggctacaaataagatctttttattcttcagactctcaatatcttctgaaatcagttcagatggacatccgagtggtcctgtgaaatctctgaaagagtctcctgcttttaattgtgccatcttctcagtagatgctcctactgtctggaatacgatggtaattgttccttcttctctgtcataatcgcagattgtcagcggaattctttcccccttgtcatccatcttgacaattacgaactgtcctggctcacagtgctttgccacacgtggtgcttctacatccataagataaatcttatcagccagtttttcagcttttcttatcttgtacattgcattgcctcctaaaatatttactctctttatgataaattattgcaaagtaaatagcaagtatttctttttaatttgttaaaaaattatttatgtcataaatataactatcttttttatctataagtactaatatttcttctataaatctgccaaaattcttccggttaccaaatttttcaaccgtattaaatcttgtgccggcacgaatttgtacctgctgaccggatataaaatgagacagacggtcagtatcgaggccgtctgtctctgtaagaactatattctcttttttagaaatctacttctgttccataatatgtacagttgaaaagtttttccatagctgccggatcgatcggacgtgggttggatcctgtacatgcatcaccaactgcaagttctgaaatctttgcaattttttctttgaattctgcttcgtcaataccgaaatctttcagtgtcttcggaatattcagttctacattaaatgcatcgatctttgcacacaggctgttgatcagcgctttctcagatgtacccggaagtcccattctgcgtgcgatttctgcataacgttttgcagcgaccggatcttttgcattatacttaattacatatggaaggtaaattgcatttgcgcatccgtgcggaatatgtccggttgagaatgccgcacctgtcttatgtgccatagaatgtacgattccaagaagtgcattagaaaatgccattcctgcaagacactgtgcataatgcatctgctctcttgctaccatatcacatttgtaagatgccggaaggtaatccagaaccatttcgatcgcctgcagtgcaagcggatctgtaaatggacagttcaaggtagatacataagcttcgatcgcatgtgtcagtgcatccatacctgtgtaagcaacctgctttaccgggagacccatgacaagatccgggtctacaattgcaacgtccggtgtaatattaaaatcggcaagtgggtattttactccggtctgatagttggtaataacggagaatgctgttacttctgttgctgttcctgatgttgacggaattgcagcaaattttgcttttgttcttaattccgggaagttgaacggaatacagagatcttcaaatgtaacatccggatattcatagaatgcccacattgcttttgcagcatcaatcggtgatccgccacccatagctacgatccagtccggctggaactcctgcataactgctgcacctttcataacggtctcaacagatggatctggctcaacaccttcaaaaagctttacttccattcctgcttctttcagatagttctcagctctgtcgaggaatccctgacgcttcatggaacctcctccgacaaccaggattgctttttttcctttcaggttcttcagttcttcaagacatccttttccatggtaaatatctcttggtaatgtaaatctgctcatttcaaacactccttcgcccttaaagtatgttatctttttgacaatcacattgtatctcaattctatcctttttgcaatattttaccacaaatagattgtatttatttccatacaattatacatttttaataaaccatattatccacactctattcataaaatatttgatttgtgatatatttcacatatttacgcaagttatccacaaatgaaagtaatcgaaaaagagtacgctttaccagtcatgctctgacaagcagacggctcggcatactctcttcttaaaatcgggttttactctatattcagttcataatttcttcttgtgacatcacttaatctgcctttttggtcctgcagaacaaagctgaaaatcgtacttcccgccggcattacgatcggcccggtatactcctgcgtcgcagaattattctccggatccggatctgatccatccgtcgtgtaatatgccgtatacttatccggtacaactacactgattgattggacatggttatactgcccggtcgatggagtcaccgccggcgcatctgcaatcgggaactcaactttataagttttactttctgtcaggcttggaattcctttcttattaacagaaattgctttcaccgtcgtctcaccttcaccgatcttgatcggttccgtatatttcgtacttgaagttgtcggctctgaaccgtctgtcgtatagtagattgcttttccttttccggtcagttccagtgcctgcacttcatcatatgtctctgcctcatccagactaaactccggttcatctgacacataatccttcagtgcttcaagaaccgtatcactggtacatgcattcagaagcggtgataccttttcttcctgtttggtatcaatataaaattctaccgctgcacgataaatttctgcatttccggactgctttgcaatctcatctgtaaaaacttcttctgcctgatccagatcatccttggcaatataaacctttgaaatccctgtataagcttctgctttcttcggacttccagaagctgctttttcaaatacagtgagtgcgttctcatattcggaagctgccagaagccggtatcctttctttacttttccggtatatgaattttgataaaacaagaaaatgagtcctgccagaacaatacaccccgccagtagcataagcagcattttccggcgtttttttctggcgcgctcttttctcttttctgcccgcatacgccgcaatctgcgttcttcttcatacgctcttctcgtctgttcccgcgcatcttctctttgacccacacgtccggtagccggtctgacatcactgcgtctgaccaccgcatctcttccacgcctggtcacagtttcctgctggcggcgaccaacacttcccgaatttcccacgcacctggtctctcctccaacactttcccgtctttcatataccggatttgccgcaccagaatagctgacatcttgcttttcctgctcacccagatgaaccgacattgtctgtgtaatgcctccttttaactgagcagtcagcatatcatcaagtgggttataatcaggcacgatctgtatttccctgccgcagctaggacagatcaactgatcttcaggcaaatctgctccacagtgcatacatttcattgtctttcgtctccttctggtatcatacttcttttagaacaatccggtaattttaccgtcttctacatcaattccatttgctgcaggtactttcggaagacccggcatggtcatgattgctccggtaagagcaacaacaaatcctgctcctgcatttacatagacttcacggatatggatatcaaagttctccggacgtccaagaagcttcgcatcatcggacagagaatactggttctttgccatacataccgggaacttgccaaagcccattgattcaattcgtgcaagctgtttctttgcagcaggttcatatacaacactctttgctccgtaaatctctttgcagattgtctcgatcttctctgcaattgataactcatcactgtaaatcggatgataatggctttcttttgtctccagagtctgtaatactttctctgccagctcttttccgccgtctccgcctttaccccatacttctgcaagggcaaattcgcagcctctgtcttcgcagaacttacggataaattcgtattctgcttcagtatcactgacaaatgaattcaaggtaaccacaactggaacgccgaatttctgcaggttctcaatatgcttttcaagatttacaattccttttgcaagagcatccagattttctttgttcagttcgtcttttggcacgccaccattgtattttaatgcacgtaccgttgcaaccagaactactgcgtccggtttcagtcccgccatacggcacttgatatccataaacttctctgcacccagatccgcaccgaatcccgcttctgtgatcgtgatatcactcagcttaagcgccatcttggttgcacgtacactgttgcagccatgtgcaatatttgcgaacggaccaccgtgtaccagtgccggtgtatgttccagagtctggataatattcggcttgatcgcatcctttaacagtgctgtcattgcaccggttgcatgaagctggtcagctgtaaccggttctccggaaaatgtataggcaacaatgattctgccaagacgttttttcagatcttccagatcatctgccagacataaaattgccataatttcggacgcaaccgtgatcacaaaatgatcctctcttaccattccgtccattttatttccaagaccaactactacattacgcagtacacggtcattcatatctacacaccgtttccacacaacctgtctcggatcgattccaagagcatttccctgctggatatggttgtcaagaagagctgcaagcaggttatttgccgatgtgatcgcatgaaaatctccggtaaaatgaagattcagatcttccatcggtacaacctgtgcataaccgccaccggcagcaccgcctttaattccaaagcaaggtccgagcgatggctcgcgcagagcgatcagagcttttttaccgagctttgccattgcctctccaagtccaacggtaatcgtcgtcttcccctctcccgccggagtcggattgattgcagtaacaagtaccagctttccatctggtctgtcttttactctttccatcagttcatccgataattttgccttatacttgccgtaaaactcaaggtcttcctcttcaattccaacctttgctgcaacctcgcgaatatggagcatctctgcctcctgtgcgatctgaatgtctgtcttcataattatatcctcccttttttcttctgcgtttcttaaactgattcttctatgtattgctcaaactgttccatagacatcagtacttttcttggtttggtaccttcttcttctcctacgactcccgcctcggcaagctgatccataatccgcgccgcacggttaaacccgattttaaacacccgttggagcattccgatcgatgctttgtctttttcaatgataaactttcctgcatctacaaagtagacatctttgtcgtcctcggaagatgctcctcccgcagatacattctgattactattcacctgcttctggatctcttcactgtaggctgcgcctccgctgttctcttttaggaaatcaaccactgcctggacttctttatcagaaacaaaagccccctgaacacgtaccggcttctgatagccagccggatagaacaacatatcgccttttccaagcagcttctccgcgccattcatatcaatgatggtacgggaatccacaccggatgatacagaaaatgctattcttgatggcatattcgccttaatcagaccagtaatgacattaaccgatggtctctgcgttgcaagaaccagatgaagtcctgccgcacgcgcaagctgtgccagacggcagattgcctcttctacttctccaggtgcaaccatcatcaggtctgcaagttcgtctacgatgattacaatctgtggaagtttctgtgctttattcggatcatcaatatctttaatgttctcgactttatcattgtaacctttcagatcacggacattatactcggcaaaaagctgataacgtctgttcatttccgcaaccgcccagttcaaagctcctgctgccttcttcggatccgttacaaccgggatcatcagatgtggaattccattatatacacttaattccaccacctttggatctaccatgatcagtttcacatcctccggttttgctttgtagataatactcataatgatcgtattgatacagacagatttaccggatccggtagctcctgcgacaagcagatgcggcatctttgcgatatctgataccaccactttacctgaaatgtcacgacctgtcgcaaatgcgatccgtgatctacttttcttaaattcatctgattccagaagatcacgcagcataactgcagtattttccttattcggaacttcaatgccgaccgctgcttttcccgggatcggtgcctcaatacggatatcagccgccgccaggttcagcttgatgtcgtccgcaagtcctacgatcttgctgactttcacccccatctcaggctgtaactcatagcgtgtgacagaaggtccgcagctgatattagtgattgtaacattcacaccgaaggtttgaagtgtcttctggagctttgctgctgtctcccgcagatgcgcatccgaatctccggaggttttacttccatgcttcaacagactaagaggtggaaagcggtattccctgaccggtttctcacttcttgcaatcgtatctgcgacagcagccacctcttttgggatatctgccttaacttttgaatttccggagacctgtcttattattccgtcttctgtctgccccgctgataaattttcttcagccacatctgtctgtatatctttaccggactccgtctttttttctgcttcctgcatcgctccttttaagaacttcgggagtttttctttcaccggctcaaggggaaccggttccggatccgggatcagctctgtagcggaaaggggcatcgcacgattgatcactacatcatctagtgcaattttcccagtctgttccataatgtgctttgcagccgcttcttctgcaccggcaagcacgctgctcatatccttccggctgcgtctggtagctttcttttctgtgctttcctttgcttcttttccggctttttcttctgctttttctgcctcgttctcttttcctccaactgtcgaattaaaggaaacgccgcttacctgataatcaacacgcatagcttcccgccttgccctgcgttcctcagcctcttctttacgcttctgcatgtcctctctggcacggtcatacgctttttccccgccgatcttcattccttttagaatagacttttctgtgataaggactacacagatcaccattaaaatgatcacgacaacatatgtacccactttaccgattgccggcaccagtctgaccgcaattgcctttccgacagatccgcctttttcatcgatcagttcaaagagcacacagcactgaaccagtaatacaacgcctgcaacagtcttaatatatgcgatcctgtttcctttattggaaaccacaaacgcgactccacaaaataaaagcagtggaaatacatacgccatccaacccatcattccctgctgcagtgctgcaatctttcttccaaatgcacctgcaagtccgaaattgctgattgtgagcagaatccctaccgcaagtgtcacccagatcagaatctccgttgcaagaaatgattcttcctgcggcacagcttttgatgtggtattctttctggttgtcttcgcagattttgcagactttgcacttgtcttcttcgtaggctgccgctttttcgccgtgctctgctttgcatttttctttgttccggttgtctttgaagccatcaaacttcccccttgtatttatactctttatcttgtaatcaaatgaccgattccttctcctctctccccagatatagtatccggaatcagtcatcaaaagtgtatacttgtacatactattttattatagcatcctcttcgccttatgtcatctcataatttttatcagtattttccattttttcatcaatcatttcatgcaatttatttaatgcatctcttattccgccaacttcatcaatgagtccttcctccactgcacgtttcccttccagcattgtccccacatctttgacaagctgtgtggaatccagcatcagttcttcaatccgctcctgtgacattccggaatgctctgcaagaaatccggtgatccggtcctgcgtcttttcaatattccgcaggctttgtgccacaccgatgaacattccgcttgtccgcaccgggtgaatgatcatcgtcccacttggaacaataaaagaataatctgccgacacagcaagagggccaccgatagaatgacaccctccaagtaccagagatactgtcggtttgcttaaggacgcgatcatttccgcaatcgcaagtcccgcctccacatctccgcccagtgtatttaagagaatcagcacaccatcagtctgaacactgttctcaatctgtgccagctttggaagcaggtgctcatacttggttgcctttgtactgcctgaaaccgtctcatgcccttctacttcgccgatgatcgtgagtagctcgatctgatgattccgacgtcggtcaagcgaaagcattcccatttctttaacatgttcatcttcttcctttgtggtttccggctctgtctctctgacttccttttctttattttccatattttctacagtctgttccctgctctttttcttacgtatctggtattcttttacatccgtttcttcctgtattttcattgccgcattcctccgttctttttagcttagtatggacaatgcttatgaaaatatgcaggattttcgccacagaaatgaatcgcagattcttgtagcgacacaaatctgtacctgattcactgtatatgcaaaagagaatgcgactcggcacattctctttgatttaaacattatgaaaataaatatttcctgcgcaggctatataccatatccgtataaatcttgcggcatgcctccagattatcggattcgatcatggaaacacatgggtgaagataacggcaccagatatctgcatatacatcttctgaattttccatccggttgatccggtttacgattgtcggagcaatatcgtaatactcggcaacaatttcttcgccgcctttctgattcaccagatattcatctctgtatcttctcatcagattcagttcgtaacagtcatccggtttgccaaggcttgcacatacggctgtagtaatatagcagagacgtgatttgaagcctccctggatctgctcgaattccgatttactgatctttagttccagatcatgatcattccagcgttcgatcatgcaatctacaatctcttcacaagcatccattctgtcataacggaacatcgggatcacatacgtaaccatgcccagattatatttcataagtacattttctttttttctttttgaactttcctgatccagtacttcccgcattctatccggcagaacagcagcaatctcttcaatctcttcctgtctgtcttccgaattctcgcattcctgtgcaatctcagtaaaaagcggcttatacttctcgtatgcatttttaaacgaatccgcataagtctttttattgaaatctctggaaatcggaataatctggtcaaacaggtcattcagtccattctgtatactctgattcattcaggttcctcccggaatcgatcctatgcttcttcccagttatgatatacttcctgtacatcatcatcatcttcaagaagatcaagcgtcttctgaatgttcttgatatcttcttcgttgtccaaagttacccatgtctgtggaatcattgtaacttctgcgcttgccatcggaatacccgcttcttccagagcaagacgaacctcactgaaatcattcggatctgtaagaatttcaaagctgtcctcttcttccgaaaaatcttctgctcctgcatccagtgcctgcatcatcagatcatctgcatccagttcacattcttctttatcgacaatgatctgtcctttctgatcaaacatgaaagaaacacatccactggttccgatatttccttttccctttgtgaaagcgcttcttacattagaagcagtacggttacggttatcagtaagtgcatcaacgatgattgcagttccgttcggtccgtatccttcgtatacgatgtgttcgtagttgttagcatctccgtctccggctgcttttttgatacttctgtcaatattgtcatttggcatattatttgcttttgcctttgcaatcgcatcacggagtctgctgttgttagccggatcagctccgcctccttctttgactgctacagcgatttcacgaccgatcttcgtgaatacttttccttttgctgcgtcgtttttttcttttttatgcttgatattcgcaaattttgaatgtcctgacattactttttacctctcttcagtatttttactattctcaattgtactattttatcacttttttgtcctactgacaaggactttgcgtattgtattattatcaactgacaatacatggaacagatagcctccgaattctacctgacattcttcatcttccgaaggaattctgtccaggcagtcgatcagataaccattgatcgtatcgtaatcttcttcgttgaaactgattcccagaagctcttccagatcctccagctgtgtcataccatccacgatatatgtaccatctgcctgtttgatgatcagctcttcttcctcatcatactcatcctggatatttccaacgatttcttctacaatatcttccatcgtaacgatccctgatgtctgtccatactcatccagcacgatcaccatatggctcttgtcctgctgcatctgttgaaacagtttgtcaatcgcctttgtttccgggataaatcctgccggacggatggcatccttcagatcatgcaccggttttttccttgccggaccgtccaggtagctctgcatcgcatcccggatatgaagaatccccacaatgttgtcaatatcttcttcataaaccgggaatctggatttgttctcctccagcataaaggtaagtgctttttccagagattcctctccatccagtgctacgatatttttccggtgcgtcatgatatcttttgcatccgaatccatatattcaaaaatgttggtgatcatcttcatctcacgtcttgtcagaacacctttttcatagccttccagtactttttcaatgatttcttctgcaattttctctttatcttcattgtcagaaaatacatttttcattttctgaagtaaattaccttccgtttccattgcttcccatacttctcctcttttatgtatgaagcatcaggctgacgcacagcgcttcatcgacttttctcataagctctttgtctacccggcacacgtaatccttcagtctctgtttatcgatagtccgaatctgctccagaaggacaacagaatccttgacgattctgtacctttttgcatcgatttccacatgtgtcggcagcttcgctttattcatccttgaagtgatcgcggcacagataacggtcggactgtgccggttcccgacatcattctggatgacaagaaccggacgcacaccgccctgctccgaaccgactaccggacttaaatccgcataataaatatctccacgcctgatctgcacttctttcacactccgcttatcaagatactttcattattgccagctttctcctgctgtattcatatctctttcgaagtgcatccccgcattttagaaataatcgacctgctctacaacttttccgtcacgcagatattccctcggaacacgtttattgatatcacagataaattcatagttaaatctaccgctcaggttggcaagttcatctattgaaagataagcatccccatcgtggccgaccagtgttgccctgtcaccaaatttcacatccggaattccggtcacatctaccataaactgatccatacagactctgccaaggatcggcgccttctgaccatggatcagaacatatcctttgttggaaagacttcttgggtatccgtctccatatcccgtcgggatcgtggcgatctgcatccttttcggggcaacaaaggtgcctccgtagctgacttccgtacccttttcaatccatttcacataagtcacatgcgcgatcagctccattgccggccggagcggaactgcctccttattgacttcatctgacggatacagtccataggtagaaatcccggctctctccagattcattccaagctttggcatatcaatgatacttgcactgtttgcacagtgataataagtaaattccataccttctgctgcaagatgttctttcatccacagaaaagcacggatctgttccagtgtcgtggtcttatccgtctcatctgcctttgaaaaatgggtaaacattccttcgcaatccgtataaacaagtctgccgatcttaaggatctcctctacactttctttcgctaccggaaagccaagtcttgacattcctgtatcgatcttaatgtgcagatatgccttcttccccatacggtatgcggtctcatccgcaagcttcgcaagctcatagctgtaggttgtcatgcggatctcatgacggatcatctcttccatctggtccgggaaaatacatcccaggcaaagaattggcttctgaatgccggcttttctgagtgcaacaccttcatccagagttgcgaccgcatagccccagacatagtccacatcttccagcattcttgaaatcggcaccgctccatgaccataaccatctgtcttgatgaccacgaccatcttggttcctttttctatatttgcatgcatcatttccatgttatacatcaccgcatccagatcgatcaccgcacgcagtctgctgtatttcttcattctgtcatatcctccaattccttaagtgttctgccgagcattttcaagagatcacccgcaagcacactgtaagagccaagttcttttctggcatgatctccgcacaggccatgcagataaacgccaagcacagcggcatcatccggtctcatatgctgtgccataagtccggtaatcattcctgcaagcacatctcccgatccggcctttgccattgccgcattaccggtggtattgatcataagccttccctctggcgctttcacaagtgtcctgctgtctttcagtacacagacagcatggactttttctgtatatttccttaatagctctcttctgttgtcttttaattcctgtacgctgtatccggtcagtctggacatttctttcatatgtggagtaagtacatatccggaaggattcatccgaatctgttcgatcccccactcatcggtctttgccagaaggttcagtccgtccgcatcaataacagccggggttttattattctcaagcacctttttcagtaattcctccgaatgcggtcccataccgagtccgcatccaatacagagcacatccgcccattccagcaaatccggaagttcttcaaatgattctgtctcatccagagaataggtcgtcattaccgcctccggtaaaagttcctgtaagattgcccggttactttcctccgtataaatccggacaagacctgctcccgaaagatatgctgccctggcacttaaatatgctgcaccggacattcctttgcttccggtaatcatcagaacctttccataagtccctttattagaatccggtttcctttgcggcagcattgccggcacatcggatttttcaagtgccatgcagatttcttcttccgcaaaaaactccggtctggtaattccgatcggcgctgtaacaagctttcctgtatactcacatcccggatataggatctgtcccatcttctgaaacgcaaaggtcactgtaagatctgctttaaatgccgttccaagcacttttccatcatccgaacggatccctgaaggagtgtcgactgccaccttacaggcagtcatccgattcatctgatcaatcacctctgcgtatctgccttttatttcacgggataggccaataccgaatacggcatctataataacactatattctttctgtggcaaactgtttcctacagatattcccagattttccagaattttcatctggatttttgtttcttcactacgatggtcataatttccgaccaatactacatctggatgatttccttcttctacgagcatccttgcaattgcgaatccgtcaccaccgttattgccacttccacacacgaccaatgctttcgacaaatctatgtcttctgctttcatcgcagccacacactgaagtgccgcccgttccatcaggacaagggacgggacctgcatcttctgtatcattctctgatccgatcttctcatctgatctgctgtcagtatttctttcatatccggtctcccatacatttaattttcaaaaaggtgcaggaaaaaattttcctgcacctctgccttctggtctgctttgcctactttccttcatgttcttcattgtatctggtgatattataagataatctcatcagactttcagacaaatgaacattctcaacaataatattatccggcagattcagatctgtatgcgcaaaattccagatagccttaactccattatctaccaggagattggcaacctctactgcttttgtcttcggaatcgtaagaaccccgatctcaatatcgttttctttcacaaaatccttcaattcatccatcatacggatctcaactccacggatcgtcaatccggcaagccttgggtttacgtcaaacagcccttttaaaacaaatccccgattttcaaatgctgcatagttcgccagtgcctgtccaagatttcctgctccaatgataacgaatttatgtttctcgttcagtccaaggatcttacctatctctgtataaagatactttacattatagccatatccctgctgtccaaatccaccaaaattattcagatcctgacggatctgtgaagcagttactttcattcttttacttaattcattggatgatatccgttcgactccgctctccagtagttcccctaaataacgataataccgcggaagtctccttattactgcctgagatatttctcttgatgccactttcacttccaccttcctattttttgactcattatttttaattatataagaatctagtgaaaaagtcaaattttatagttgttttttgtcgtatttcagctataattatgttactgtgagcagtaacataattgccactttaacaggaggatataaaaatgatactggcatgtcataatctgtcaaaaagttttggggatcaggtcatcgtaaaagacggatcctttcatatagagaaccatgaaaaagctgctcttgtaggtcttaacggagccggcaaatccacgatcctcaagatgatcgtaggacagctttctcccgatgcagggacggttgttcttaccaaaggcaaaactctcggctaccttgcacagcatcaggagatggaaagcggcaataccatttatgaagaagtccgcacggcaaaagccgaagtcattgagatggaaaagcagatccgtacaatcgagatagagcttccgtctctttccggagatgctcttgaagcacgtcttgccacttatcagagactgacttctgcatttgagcacgcagacggttacgcttataaaagtgagcttaccggcgttctaaaaggtctcggatttacagaagaagaatttactaaacccgtagattctttatccggtggtcagaagacccgtgtatctcttggcaaactccttcttaccaagcctgacgtcctgcttctggatgaaccaacaaaccacctggatatgaactccatcgcatggctggaaacctatcttctgaattatccgggtgctgttcttatcgtatcccacgaccgctatttcctgaaccgtgtggttacaaaggtgattgaagtcgagcagggacagcttcatacttatatgggcaattattctgattttgctgtcaaaaaagaacagctcagagaagccagattaaaagaatacttgaatcagcagcgtgagatcaaacatcaagaagccgtgattgaaaagctccgttcatttaaccgtgagaaatccatcaagcgtgccgaaagtcgggaaaaaatgttggacaagatgacgcttgtagacaaaccgatggagatcaacactgacatccatctgaagctggagccttcccgtgtcagtggcaatgatgtcctttctgtcaaaggattaagcaaagcctttccgccacagacacttttcaccgatatcagtttcgagatcaagcgtggggaacatatagccatcattggcgacaacggaaccggaaaaactacgcttctcaagattctgaacaatgtgatccaggcagacagcggttcctttacactgggtgccaatgtggagattggttactacgatcaggaacaccacgtccttcatatggataagacgatctttgaagaaatttccgatgattatccgacacttaccaacacacagatccggaacatgcttgcggcttttctttttaccggagatgatgttttcaagctgatcggtgatttaagtggtggtgaaaggggacgtgtatctctggcaaagctgatgctctccaatgcaaattttctgatcctcgatgagccaaccaatcatctggacatcacttccaaggaaattcttgagcgggctctgaacgattataccggtacgatactttatgtatcccacgaccgttatttcatcaaccagactgccacccgtattctggaactgaccggcaatacctttgtaaattatatcggcaactatgattattatctggagaaaaaagatcttctgaccccggctgtttccacagctgcttccgaagacgcaccggcgcaggtttccgaatccaaactaagctggcaggagcagaaagaagaacaggcacgtctccgtaaaaggcagaacgacctgaagaaaacagaagaacgtatcggtgttctggaaacacgtaatggcaaaatcgatgaactgatgatgcaggaagaagtctatacgaattctgttaaatgccaggaactggcaaaagaaaaagcagcaaacgaagcagaactcgaagaactctatgaaaaatgggaagaactggctgaataagccagttcttcccattttcctgtcagagatacgcccttcatgcattccctgctctttttataatctttctgcaatcgctttaataaacccttcactgttcagtacatgtacctccggaagagttgtgatcattgccagatcctttgtcatataaccctcttcaatcgtatcaatcgttgctttttccaaacggtctgcaaaatccatcagttcctggttcccatccagttctcctctcttgcgcaaagctcctgtccatgcaaaaattgttgcaacagagtttgttgaagtctcttcccctttcaggtgtttataataatgacgctgtactgttccatgtgcagcttcatattcataaaagccttccggtgataccagtacagatgtcatcatggcaagtgaaccaaatgctgaggaaaccatatcactcatcacatccccgtcataattcttacatgcccagatataaccaccctctgacttcattacacgggctaccgcatcatcgatcagtgtgtagaaatattcaattcccgcttcatcaaaaaggttcttatactccgcatcaaagatctcctggaagatatctttgaaagtatggtcatattttttggaaatggtatcttttgttgcaaaccaaagatcctgctttgtatccagtgcataactaaaacagcttcttgcaaaactttcaatcgatgcattgatattgtgcattccctggataatacctgctccatcgaaattatggatcagctctcttgtctctgttccgtcaggtgccgtgtagaccagctctgcctttccaggtcccggaatcttcatctcggttcctttatatacatccccataagcatgacgggcaatcgtgatcggcttcttccagttctttacacatggttcaattccttttaccacgattggagcacgaaataccgttccatccagaatcgcacggattgttccgttcggactcttccacatctctttgagttcatattcttttactcttgccgcattcggtgtaatggtcgcacatttgactgctactttgtacttctttgtcgcattagccgaatcaactgtaacttggtcatctgtctcattgcggtgttccaatccaagatcataataatctgtcttaagatcgatatacggcagaagaagatcatcttttatcatcctccagagaattctggtcatctcatctccgtccatctcaacaatcggtgtcgtcatctgaattttactcataacttcgtctcctttttggctatttttcttcgatatgcaggttctccataacatgcataatatggatcgttgccagattgccggctttttccgcatccttcgccttgatggcattcaggatctcgttatgctcaccaatcgacttgatcgcacgctcttctgtcttaacggaagtccttcttgcaagctgtacatatttgtgaaaatctgaaagcacatgatccagaatcctgctctgtgatgcctcatacagaatctgatggaatcttccatccagctctgtcagctgatcggaatgtcctttatccatatgatactcggataaaagaatgatctcatccagttcttccagctgctcctgtgtaatatgttctgttgcccaacggacgcataatccttccagcatggaacgaatcatataaatatcatgtacatccttatcggaaataccggtaacataagctcctttatttgggatgatgttcaccagtccctccagttccaactgtctaagtgcctctcttaccggtgtacggctaactccaagttccttccccaatgttgcttccctgagttcgtcattttcttcatacttacctttcagaatgtcatctctgatggtctgaaaaacctgacttctcaatgaatactcttccattttatctctctcctgaatttcgttagattgtaatccccttttcgtcacagattctctcaatctcccggattagttcctgatctgtgagtacggtcacacggccggattcatattccgcgtcaacccacttcttcaattctacaactaaaatggaattcttgtctacctgtttctcatttttcaggtgataatatgtatttatccagtgtgcaatgcctgcaagaccggaagtatttgacacagcaaccagcggtggacggttcagaaacttgccggtatcaaacacattgtagatttcttcgttctttaacagtccgtctgcatggatccccgcacgggttacattgaaattctttccgacaaacggggtacgcggcggaatctgatatccaatctctttttcataatattctgccagttcagtaatcaccgttgtatccataccatccagcgttccgcgaagctgcgcatattcaaaaatcatcgcttccagcggcgtattgccggtacgttcaccgattccaaacaaggaacagttcacaccacatgctccataaagccaggccgttgttgaattgttgactgccttgtaaaaatcattatgtccgtggaattcgatcagttcactcggtacacctgcatgtactctgagtccgtaaatgatacccggaatggaacgaggaatcacagcccccggatagttgactccgtatcccattgtatcacagacacggatcttcaccggaatctgatattcttccatcagatgcatcagttccagacagaatggaatgacaaatccataaatatccgatctggtaatatcttccagatgacatcttggactgacaccggtctccagacattcacgtataactgacaaataatgttccatcgcctctcgtcttgtcatcttcagtttataaaaaatatgataatccgaacagcttaccagaattccggtttccttcattcccagatcttttaccagctcaaaatcctttttatttgcacggatccagcttgtgatctccgggaacttataacctctttccatacatttatatacggcatcacggtctttcttgctgtataagaaaaattcactctgacgaatcttcccctgcgaacctccaagcctgtgcatataatcgaaaatggttacaatctgatccgttgaatagggtgctctcgactgctgtccatccctgaatgtcgtatccgtgatccagatctcatccggcatactgtgcggtacaatacgatcattaaacgcaatcttcggaatctcatcataatgaaacaggttccggaacacattcggtgtgtccacgtctaccagcgggtacatatgctcctcaagttgcaataaatttgtatgcttatccagataaaccttcctattttccataaccatcactccctgacctgtatttttgtattattgtatacaactataccttcgatgtcaaccccattttcctcatttcgtgactttaacccagtatttcattcaattaaagtgctaattggttaaattaccatatttttccatctatatctcccgtcttcaacaagcacccaatcacatttgcaatctctctccctcactatgaagcagtcctgcccttttaaccaataccgttcattggccgggcgagaaaaagaatctcttccaatcctactacaatatatttatggttaatatcccttacagccagtaaggaattatccatcttgttgcttaagctgtataatgatggagcaatcggtatatcgtcttccaatcttggacttcgcgtccgtaaattagactgataaccagctcctcattcgcagcgttcgttttatgcaggttgaatcgccataggtgcattcgcgtcacaccacagtagattgaataggcaatgagtaaaactggtatttatccattgcaataatcttaaggagtgaccatttatgaacgcagtaggtatcgatgtttcaaaaggtaagagtatggttgctatcatgcgacctttcggtgaaattgtttccgcacctttcgaaatcaaacacacagccagtgatatccattcacttgtagaactcatcaactctgttgaaggggagtcccgaatcgtgatggagcacacaggacgttattatgaagtcctcgcccatcagctttcaaaggcaaatcttttcgtcagtgccattaacccaaaacttatcaaagactttgataatgattctcttcgtaaagtgaaatctgataaagcggatgctgttaagattgcccgatatgctcttgacaaatggcaaaatcttaaacagtataatgttatggatgaattacgcaatcagctcaaaaccatgaaccgtcagttcggcttttacatgaagcacaagacggctatgaaaaataatcttatcggcatccttgaccaaacctatcctggtgttaatacttactttgacagtcctgcacgcagtgatggcagccagaaatgggttgattttgcatctacatactggcatgtggactgtgtccgtaaaatgtctctgaatgcctttatcgaccattatcaaaactggtgcaaacgtaagaagtacaacttcagccaatccaaagctgaggaaatctatggaaaagcaaaggaacttgttcctgtacttccaaaggatgccattacaaagcttataattaagcaggctgtggatcagcttaacagtgcctctacaactgttgagtcactacgcactctcatgaatgaaactgcatccaaactccctgaatatcctgtcgttatggctatgaaaggtgttggaacttcactcggatctcagttgatggctgagatcggagatgtttcccgtttcactcacaaaagtgctattactgcatttgccggtgtagatcccggtgttaatgaatctggaagttatgaacaaaaaagtgttccaacctcaaaacgaggttcctctgatcttagaaagactttatttcaggtaatggatgtcctaattaaaacacatcctcaagatgatcctgtttatcagttcttagacaagaaacgtgctcaaggcaagccttactatgtctatatgactgcaggtgccaacaagtttctaagaatctactacggacgagtgaaagaatatctttcatctcttcctaaatcttaattatccactaatattttcagaccagcactggtgtggtggtcttattttgataccaaattttcaacctgtataaaattttcaatgttcttcaatttagccttgactttttatttgcaggctattttgtgcaatggagatgaaactcaaaaattatggaagcctctgctgacataattttcgccttcagaggttcatcggaatggtttgcacaacctggattggaagagattctttttctcgcccgacctaacaaccttattttcaaaaaagacagcctcatccctcaccaggggataagactgtcctcttaaacattctaatataacttcgcactgatcagcttcggtctgaacccggctgcctccaatgccgcaatgatccggttcttatgatcggttccaaatgcttccagtgtcacacgaagctccacagccgcattccggttaatacttacaaactgattatgttccagtttgatcacatttccctgctcttctgcaatcgtctgtgccacttttaccagttcacccggtttatccggaagaagtaccgatacagagaagatacggtctctctgaatcagtccgtgctgtacaactgaagacatagtaataacatccatgttcccgccgcttaagatagatactactttcttacctttcagatccagctgttttaaagcagcaacggaaagaagaccggagttttctactaccattttatggttttccaccatatcaaggaatgctccgaccagttcatcgtcttctacagttacgatctggtctacattttccatgacgtatgggaggttctgttccccgactttttttactgctgtaccatctgcgatcgtgttggcacttggaagtgttacggtatgtcctgcttcgattgcagcagtcatacttgctgcttctgccggttccacaccgatcactttgatctttgggttcagcattttcgcaagtgtagatacacctgtgatcagtccgccgcccccgatcggtgcaaggatataatcaacggtcgggagttcctggacaatttccattgcaatcgttccctgtccggtagctacatccagatcatcgaacggatgtacaaaagtatatccgtactcttctgcaagctcataggcctttgcgcaggcatcgtcatagacatctccgtgtaaaacaacctcggcgccatagctcttggtacggtttaccttaatcagcggagtgacagttggcataacaatcgtcgccttacatccaaacgcttttgccgcatatgccacaccctgcgcatggtttcctgctgaagctgtgatcagaccttttgcacgatcttcctcagaaagtgtgctgatcttgtaataagctcctcttaatttgtatgcacctgtgtactgcatattttccggtttcaaatagacctttcccccggtctgactactgagatactcactgtagataagctttgtcggacgtgtcacacgttttacgatctcgcttgcttcttcaaatttttccaatgtcagcatattattattcttctccttcttccttcttttcttctgttgtaaataatgcctgtacaaattcgtcggaatcgaatttctgcagatcatcgattgtctcaccgacacctatatatttaacaggaattccaagctctgcctgaattgcaactgcaattccacctttggccgttccatccatcttagtcaggataattcctgtaatatccgcaacatcactgaattcctttgcctgtgaaagtgcattctgtccggtcgttgcatccagaacgaccaaagtttccctgtatgcttccggatattctctttccagcacacggttaatcttcttcagttcctccatcaggttctttttattgtgaagtcttccggctgtatccaccagaaggatatctgcctttctcgcttttgcagccgctaccgcatcataaacgatggctgccggatctgcaccttcctgtccgccgatcagatctgcatccgaacgatgtgcccattcctttaattgatcgcccgcagctgcacggaaagtatctgctgcagcaagcacaaccttcttgccctgacctctcatcttaccggcaagttttccgatagtagtcgtctttccgactccatttactccgatcaccagaacaacagaagtctggttttcaaattcataagctgtctcgcctacatccatctgctctttgatactgtcgatcaggagctgtctgcactcaatcggctctttgatatgctgttcttttacttttttacgaagatcatcaagaatcgcgtaagttgcttttacccccagatctcccatgatcagaacctcttccagttcctcataaaagtcctcatctatctttgaaaatccatgaaaaatactgtccattccagacacgatattatcgcgcgtcttgttaagtcctgctaccagacgcttaaaaaatcccattttttcttctgccatcatatcctcctatccactactttgtaagctcatcttccagaagatccacagataccagcgttgatacccctttttcctgcatagtgatcccatacagccggtctgccgctgtcatcgtaccgcgacggtgtgtaatgacgataaactgtgtatttttcgtcagcttgtgcaaatactgtgcaaatctcgtgacattagaatcatccagtgccgcctcgatttcatccagcagacaaaacggggaaggtttcagattctggattgcaaacagcagcgaaatcgccgtcaacgccttttctccaccggaaagctgcatcatattctgaagttttttacccggcggctgcgcaataatccggattccggcttccagcacatcctcatcatccatcagttccagagttccttttccaccaccgaacagttgtttaaacacctgattaaactcctggctgatcttcgcaaactgctcagtaaactgcttgcgcatcgcctcgtccagttcttcaatgatcttcttgagcgttgcttctgcctctaccagatcatcatgctgcgttttcataaattcataccgctcggaaagatttttaaaatcttcgatcgcattgacgttcaccgatccgagtttccggatctccgtctttaattcctggatccgccttcgcatctcggcaggatctgtcagactctcatcccggatttccagtgcatgattatacgtcagttcgtactcttcccacatataattgatctgcttttccaaagcttcctcgtagccttctttcttgctggtaagccggaaggattctttatcaagctctgccatatgggctgccagatcttctcgctttttcaggaatgccttatgcttctgattcagttcttcccgctttttctgcgattcttcgatctctttgttgatttcctcaaataattcctttgaattctctatcgtctgccggatttcggtaatctgtgcttccttttgctctatttcaccgtgattctctcctttgcttgcatttaaagtggcaagctcttcctggaattttcccatctcttcccggatacggacaaaattctcctcgataaaatcttttttctgctccaatgcagcaaaactgaggtgaatattttcatttttgcgcacttctgccgcttctgtctcacgctctttttccagccacttctgtgagctttccatctggcgtgtcagctcgtcctccagttgctggctggtctccagttccattttgatcgattcttcgttttcctcgatctcatgaacctgttcttccagtttcttgcgctccgcataaattccttctgaattttctctggtcgcattttgacggctttttacctggtccagattcatcttcgcagtattttgaaccacatagtcattctgcaattcctgctggatctcttccacctttgcatacagcgtcgtccgcttctcctttgcggccgcaacttctgtttccgatttctggagttctgttttcagacgcgcaaccgtcttttccagttcttcaatctcacgtcttctgctgagcagattactggaattcttaaatgctccaccactcattgctccgccaggattgatcagatctccttccagcgtaacgatacgcagggactgacggtactttcttgccagacggatcccggtatcaatgttgtctgccacaagagttcttccaagaagatgctctgcaagagatgtaaatttatcttctaccgttaccagcttgtccgccgtgccgatcacccccggctcgcgaagggcttctgccctggcaaatccctgtcccccacgaatcgctgtcaatggaaggaaagttgcacgtccataccggttctgcttcagataaccaatcattttttttgcagtctcttcgtctgcagtaacgatattctggatactgcctccaagtgcgatctccaccgcagtctcatattttttatctactttgatcagatcagccacaacccccaggattttcggctcgcggcttttctgctccatcacacgacggatactgttcccataaccatcgtaacgctccgtaaggttcctcagagactccagacgagagtactccctgtgataagcattctgcctgtttcgcaggttttcatttgcctgtccgatctctttttgcagtccggcaatctctgtttcatagtttttgatctgttctacagaatccgtgatcttacctgatactgccttcagttcttccgtatactgcgcggcaagttcctgttgcctctgtacatcactctccgcttctaccagacgtttgtaaagcagtgcccggcgtaccttgatctgttcaagcgtcgtttcataatgctgcagctttgccttcgtggatgcacggttattcagaagctcacggatatcgttctgattcttttcaatctccactgtcatctctgcaatccggctctgcagggcagtcagctcctctcctgcctgcttttgtctctcagatgcagctgcaagatgtctgtcgatctctgctttttcttcttccagttcggatttctgcctttcacggtttgcaagctctgcctgaatatcgtttgcgcgtttttcatagtgttcatcattcatacggacactgttgatctgctcttttaaaagctcgatctggttttccaactgctgcttcagaagtgttgtctcatttctctggctttttgcatgctcaattccggcgtcgatctcatctacttcctgctcgatcttctcatactgtgccttcatatcttcatgctttttgccggcttcaatgagttcatcctgcgcaatcttcagcttctcatcgttttcccggatctgccccttcagacgtttcatctccaccaggaacatattgatgtcataatgcttcagttcttctctctttttcagatattccttcgctgtctccgactgtttctgaagcggaccaaactgcttttccaactctcccaaaatatcattgacacggaccagattgctctgctcttcttccagtttgcgaagagataacgccttgcggcgcttaaatttgacaatcccggccgcctcatcaaaaagctctcgtctctcttccggcttaccgctcaggatcttgtcaatctgtccctgtccgatgatcgaatatccttcttttccgatacctgtatcataaaacatctcattgatatctttgagcctgcagacactgccgttgatcagatattcactttcccccgaacggtacaactttcttgtgactttaacctcttcaaactccaccgggagtttgtgatctgaattatccagtgtgatcgcaaccgatgcgtagctgaggggtttccggttttccgtaccggaaaaaataacatcctgcatcgtacctccacggagctgcttcaccttctgctctccgagtacccagcggacggcatccgccacgttacttttcccacttccgttcggtccgacgattccggtgatcccgttatgaaattcaaagacaatcttatttgcaaaagacttgaatccctgtacttcaatactttttaaatacatgcctcacctactgtacctttccttctttcagcttcaggattgcctgataagccgcttcctgttcggcagcctttttggttcttccgataccacatccaaaggcttctccgccgatcacaacctctacacggaaggatttattgtggtccggtccctcttctcctaccagctggtagacaattcctttttcctgaccgccctgtaccatttcctgcaggatagtcttgctatcataaaagagccgtttcccttccaggtcgtttaaaatatattttaaaataaactctttcgcattagcaaaaccaccatccagataaatcgcaccaatcagtgcttccaatgcatccgaggtaatagactctctgaatcttccaccggtcgcgtcctcacctttcccaagcagcagataacttccaagttccagatcccgcgcacaaaatgcaagtgccttctcgcataccatgcttgctcttaacttagtcagttctccttccggcattgtctggttctcgaaaaaaagatattcgcttgaaatcagttccagaacagcatctccaaggaattccagacgttcattacagtctgccttcttcatatgcttttcattcacataagagctgtgcgtcacagcatgtctgagcaaatggctgtccttgaaattgtagccgattttttcttccagttcctttacatttctgctcatgattgctcctccaattttaaaaaaggacactccccaaaaatggggatgtcccctgtaatcattttccctagttaacagcgttcttgatctgttctacagcatcacctactgttgcgatcttttctgcatcttcattttcaatttcgatatcaaatgcatcttcaattcccataataatctggaaaatatcaagcgaatcagctcccagatcatctacaaatgtagtgtccatcgtaatttcatccgggttacatcccatcacatcaacaataatgtctttcagtttttcaaattccataattcttaatcctttctgagcttattcctgtgcggatttttcttccgcctgaatacattctttgatcttttcattgattccttcttctttgaaggttacacactgcaaaattgaattgcagacttcttttgctttggaactgccgtgtgtctttactaccagaccggtgagtccaagcagtggtgctccaccgtactcacttgcgtcaaaatccttcatagtctttttcagcaccggcttaaccagaagtccaccgatcatgccgcggagattctgcttcataccacctttaatcttgcttacaagaaccgatgctactccttcatagagtttcaggatcacgttgccggtaaatgcttcacagacgataacatctgcctgtccgtgagggatttctctcgcttcaatgcttccgataaagttaatatccttacattctttcagcataggaaaagtctccttgaccagggcattacccttttcttcctcagctccgatattgacgatcgcaaccttcggattcttgactcccataatatgttccatatagatcgaacccatcttggcaaactgcaccagatgtgaaggtcttgcatctacattcgccccacagtcgatcaaaatggagaatcctttttctgtcgggatcagtggtgcaagcggtggcctttccacccctttgatacgtccaaccagaagctgtcccccggcaagaaccgcaccggaacttcctgctgaaacaaaagcgtcagcttctttatccttcaccatcttaagacctaccacaatggatgagtctttctttctgcggatcgccataaccggcggttctgctgtctcaattacttccgatgtatgaacaaccgaaatctgttctttattatatgtgtacccggaaagttcctgattgatgacatcttcttttccgaccagaatcacatggatcgcatctgacttcccgaccgcctcgaccgcacctttgatgatctcatgcggtgcgttgtctccgcccattgcatcgacaacaacttttgttatttctttcatactgttacctcccagcattactaaaccaattctactagacatgaccgtaaaaatcaataatatttagcagatttaggaaaattagaaaaaagaaaaggagttaagcaatacgcctaactcctgtactatagccttttttaattagttttctacagtaacgatttctctcttgttgtaagatccacaagctttgcaaactctgtgtggcatcataagttctccacatttgctgcatttcaccagattcggtgcgctcattttccagtttgctcttctcttgtctcttcttgctttagaagatttattctttggacaaattgacataggttacacctccttaaaattcttgtaaagatcgcggataactgacattctagggtcaagactggtgtcttcgcagtcgcagcttccctcattcaagttctgaccacatacactgcaaatccctttacagtcttcgctacatagaactttcatcggccaccctactaaaatctcgttatagagcagctgctccacatcaagatgatatccgtcaatgtaattcgcttcatcggattcgccatcatcttctccgtctgccagagctgtattcacctgcttttcaaaggaaagcgtgaaatctgtcggtacatctgtaagacatctgtcacacggaatgattaccgtaagacttgtctcacaactgatatgaagttttttttcgccggcatactcgacataaatatgcacaggctgtgtccggcttaccggaaatctgcttccgttcaccttcacttctttcatctcagtgccgaccacttcgtcaatggacttatgcggttcagataagacttcggacaggtcaattaacataattctttctcctgttcacacctaaactattataccatgtaaattctttttgtcaaggatgatttacagattttaaggttttttctaatttcttctgttatacaagtgcaactgtctctcttgcaattgcaagttcttcgtttgtcggaactacaagaactttcactttggaatctggtgtagagattatgatctcttctccacgttttccatttgcttcttcatcgattgtaattccaagatatccaagatagctgcagacttttgttcttacaagtgcacagttctcaccgatacctgctgtaaatacgatattatcaacaccgttcattgctgctgtgtaagcaccaacatattttgctactctgtatgcaaatacgtcgattgcaagttctgcacgcttgttgcctgcttttgctgctgcctcaagatcacggaagtcgctggatacaccggatacaccttccacacctgatttcttgttcaggacattcataattcctgcaatgtcaaggttttctttcttagcaatgaattccatgatcgccggatcaatatctccggaacgtgttcccattacaagaccttccaacggagtaagtcccatagaggtatctactgattctccgttaagcactgctgaaacagatgctccattaccaagatggcatacgatcgtctttgttgcgttgtatggttttccaacaatctcagctactctcttagatacgaagctgtggcttgttccgtggaatccgtaacgtcttactttgtatttttcataatattcatatggaagtccatacatataagctttctcaggcattgtctgatgaaaagcagtatcaaatacaacaacctgtggtgtgcccggcatcaggctttcacaagcttcgattccgattaagtttgccgggttgtgaagtggtgcaaggtcattgcactctgcgatcgcagcttttacttccggtgttacaactacagattttgcaaacttttctccgccgtgaacaacacgatgtccgactgctccgatttcgtcaaggctcttaacaacacctgtatctgcatctgtcagcgcgtcgattacgaactggattgcttctgtatgtgtaggcatagccttttcagatacattcttctctccacctgccggctgataggtaagtcttccgtcaataccgattctttcgcaaagaccttttgcgagaaccgcctccgattctgagttgatgagctggaacttcagtgatgaacttccgcagttgattactaatacattcattgatgtttctcccttctggtactagaattttctttattagaactcacactctattcttaattatactccttgcacacattgtatacaagtaatgttatttttttcacgtaatattttccagtacaatgttttttgcacaaaaactctttttatagtataatcttttcacaaacaacacaaaggagattttagttaaaagtatgaaaatcgtcggtatcatcgcagaatataatccgttccacaacgggcatcagtatcatatagaccaggcacttcaaaaaacaggggcagatgcggcagttatccttatgagtggtgacttcgtccagcgtggcgcccctgctatcgcaccaaagcatttgcgggcaaaagctgcccttcttggcggtgcatcactcattctggagctcccggtccttttttcctgtggcagtgcagagttgtttgcaagaggtgccgtttctatttttaacagtcttggctgtatttcctatctctgttttggcagtgagtgtggcgatatcaaaaaactcaatcggcttgcccggattctttccgaagagccagaagtctaccggcagctcctgcaggatgagctgcgaaaaggccgaccgtttccgcaggcacgccagactgccctaagtgtctatacaaaggatccgtcccttgccgaaatcctgtcctcaccaaacaatacccttgggattgaatacttaaaagcgctccggtatttcaaaagtccgatccagcctttcgcgattccccgcgagggatccggctaccacgatactgccctctgcgaaaccttcagttccgcaactgcgatccgcaaccgaattctgaatccatctttaccagaagatgctttttcatccgtcgcaggacaacttccgcccgcttcttcagatctgctgcgaaagaattaccagtcctcacttccggttacccaggatgatttttcgctcctgctaaagtatcgactgctctgtgagagtgcttcctctctgaccgattaccttgatgtcagcaaagacctcgccaaccggatcatcaatcagagaaatgattttgctacctggagttccttctgcgatcttctgaaaaccagagagcttacctacacccggatcagccgcaccctgctgcacatcctgctcggcatagaaaaggacaccttccgacatgagcctcctttctgttttgcagaagattccggcaacatttccggcaaagcaaaaaaagagcggtcatccacatccgccctttatgcccgcgtactcggttttcaaaaaaaagatactcaaattcttaaagagatcaaagagtatgccgccatccctctgatcacaaagcttgcagatgccagaaatctcacctccgccacccaggtcctcctgaacctggacattttcgcatcagacctgtatgaatccataattaccgagaaatttggcacaccttttacaaatgaataccagaagcagttgcaaattatttaacccttcccctttgtcaaaaaagagactttttgcacaccaccactacgcatgtttgtgcaaaaagtctctttctcatttagttcacatgaagaattttggtaagagtcactgccctggctccaggtccgatatggcatgccacactcaacgacagtggatccatccggatttcaaactccggaaatgcttcatgaagctcatccagccattcctgtgcctccttgcggtctcctgtgtaagctgcatccagatacaaatctttttttccatcacaatctccgaattctgaagtacgaatctcattaattgtcttgatcatcgtcttctttgcactcttccatcctcttgacttcgcaaacgcatccagcttttctcctttaagacggagaactggcttcaggttcagaaccgttccaatcgctgcagctgccggtgtaagtctgccgcctttcttcaggtattttaaagtatctactgtaatatagatatcactgtcccactggatcgcttctaacagttctttaatttctgccgcgctctttccagcatctgcaagctttttcgcctcttccaccgatcttcgctgcgtaacagaaatccggtgattatttacgacctgtacttttccatcatagtcctgggaaagcatgattgcagtctcacatgaactgctaagaccggctgacatcggaatatgtacaacctcatcatattcctccagcgccttgtcccacatatccattacatctccgggagccggttgggaagtcttaatatctgcatctcctgccagtttttcataaaactcctcctgcgtgagtgtgatatcctcgtaaaacaactcctcattgatatagaatggcatcggaagtacgtaaattcccattttctttccttctgcctgtgtaattccactgttactatctgttacaatcgcaactttccccatgctctctttacctctttctaatttttaaaactatgtatcggtgcaggaattcttccctttcgattcacaaatgcactgcagtcaaattcattgaccggcatgatcggcgcatatcccaaaagaccaccaaactctgccatatctccaacatcctttccaactacaggtatcacacgaaccgccgttgtcttctgattgaccattccgatcgccatctcatccgcaatgatcccggaaatcgtagtagctttcgtcttacccggaatagcgatcatatcaagtcctaccgagcagacacaagtcatcgcctccagcttttctatacaaagagatccggcattgactgcatcgatcattcctttatcctcactgaccggaataaaagctccgcttaaacctcctacataggaagacgccataacgccaccttttttcacctgatcgttcagcatagcaagtgctgctgttgttcctggtgcgccaactctctcaagtccgatttcttccagaatctccgctactgaatcgccaacagccggtgtcggtgcaagtgacaggtcaatgattccgaacggaataccaagccttttggaagcttctccggctacaagctgaccaacccttgtcaccttaaatgcggtcttcttgatcgtatcacaaagttcctgaaagccctcgccacgacatttttcaatcgctctttttacaacaccaggtccgctgacaccgacattgatcacggcatctccttcggtaacacctaaaaaggcccctgccataaacgggttatcatccggtgcattacataaaactacaaattttgcacagccaatcgaatccttgtcctttgtcgcctctgctgtctcttttacaatctcgccgcaaagacggactgcatccatatcaataccagtctttgtcgaacctacattgaccgaactgcacacacgctctgtctttgccattgccatcggaatggaacggatcaggagttcatcgctctttgtcattcccttggatacgattgcagaatatcctccgataaagtttacaccgacttcctttgctgctttatccagtgtctctgcgatcgtcacaaaatcctctggttttttgcaggctgaaccgccaacaagtgcaaccggtgtaatggaaatccgcttattaacgatcggaattccaaattcactttcgatcttctctcctgtcgatacaagatcctttgcaagtgttgtgatttttttatatatcttttcattcagtctgtccagatctgagtcaatacagtccatcagactgatacccaatgtgattgttcttacatccagattttcttcttcgatcatctggtttgtttctactacttcgtaaaaattaatcataacggttctccttacactctgtgcattttttcaaaaatctcttctctctgacaatgaatattgacaccgatctgtaagccgatatcacgaagttctaccgctacgatatccagttctttttttgaattttccacatctgcaaccgccatcatattaaaatacccatccacgattgtctgggaaatatttaaaatattgatattggtctctgccaggtatgtacatactttcgcaataattccgaccgaatctttaccgactactgtaataatgcatttcttcattctgcctgtcctcctgaatctaattctgcatactttctttttctaaacctcgatcactgcagacacctgatccctttttgcaactgcgatcggtatatcatcccccttatacgggttctgccccaaagtgacctccagcttgacagtctcatatgcaagttcttcgtaattattctccttgctcaaatgccccagcaatacactccgcaagttattgtgtagtatatcacaaagaagccgtcctgacaattcatttgataaatgtcctctgtccccaagaactctctgcttcaggtaatacggataaggaccgacttccagcatatgtatatcatggttagattccagaagaaccgcatttaaatccttcaggttctctaccgtatattcatcgtattttccaagatccgttgctaccgcgatcttctttccatcctgctcaaagcggtagccgctcggttcatttgcatcatgggaaatagcaaatggatgcacgtcaatatcacccagcttaaattctttgtctacctggatttcatggtaaagtccttccggcattttcccgagatttttataatcacggattccctgaatcgttcccggtgttccatagatcgggacctcatattttctactgaatacaccaagtccctgaatatgatctgcatgttcatgggtaatcaggattccatccagctctttcccttttatttcaagttcctttaagccttcctcaattcgttttttgctgattcctgtatctacaagcagatgcgttcgatcgctccccacataaatacagtttccgctgctgccactggcaatgctgcataatctcatcttgtttcttctccctgttcttagcctcttcccagtgccaagtctatctgtttttccgtttcttcaaaggttccgccgttttcgatcacaagatccgaaaccgctgtaaatgtctcttccgacggctgatttgcaaacaccgcatacatttttttatctgaatatccgcgtgaacttctcagtcgctccatccggatctcctgtggcacatgaatataccagatctcatccaacatctcacgatataccggttccgtaaggagtgcggcttccagaataaaaagctcttttccctcttcctgcgccttctgcatttcctcccggatcttttcattgaccgccggatgcacgatcgcattaagcttttgcagtttctctggctgatcaaacacaattctgccaagaattttccgatcaatcgttccatcaggatttaaaatttctttcccaaacgtctccacgaccttctgataacatttttctcccggaagctgtacctgatgtgccaccagatctgactggcagatcaccgcaccgcacactacacttaaaaagtcgagtactttgctcttcccggaaccaatgcctcctgttattcctatttttctcatatctatttccttctattttgcctcataccagttttttccactatgcatgtcaatttcaagtggaacggaaagatctgccgcatgcatcatgccttctttcaggatctcccgcacttcctcttcctcttccttccatgtctcgatcagaagttcgtcgtgtacctgcagaaccagcctggatttcatgtttctcatgcgaagctctttgtccacagcgatcattgcgattttcatgatatctgcagccgttccctggatcggagaattcattgccacacgttccccgaattgtctctgcataaaattgctggaagacagctccggaaccggtcttcttctgccaaataaggtcacaacatatccctgttcttttgcatgagcaactgcatcatccagaaatttcttgatgcccggataggtttcaaaataacggtcaatatattcggtcgcttcttttctcgtaatacttaaatcctggctcagtccaaaagaactgatcccataaacaataccaaagttgactgcttttgcatttcgcctctgcagatcggtcacttcatcaaacggagtatgaaacacctgagaagctgtgatccggtgaatgtcctttgcttcccggtatgcttcgatcagtgctgcatctccggagcaatgtgccagcacacgcagttctatctgcgaataatcagcatctacaaacacatatccctcttccggcacaaatactttacggatcagccgtccaagttctaccctcgccgggatattctgcaggtttggctctgtactgctgatacgtccggtcgctgtgactgtctggttgaattttccatggatccggtgatcatcttcatgaataaacacggcaagcccatctgcataagtcgatttcagcttggcaagctgacgatattccaggatttttgccacgatcggataatccggtgccagcttatccagtacgtctgctgccgtcgaatatcctgttttcgtcttctttccatttgggagggacagatgttcaaaaaggaccacgcccagctgctttggtgaattgatattaaattcttccccggcaagctcataaatttccttttccagctgtacgatttttccgccaagctgttccccatagtttttcagttcttctgcttctacacgcaccccattctgctccatgtggaacagagtaaatacaagcggcatctctatttctgtaaaaagcttccacatttcctcttttttcagcttttcttccaaaacttccgatgacgcaaatgcagcataggcttcataacagaccattttttccagttctgtcttcggatcgatcatcaatccaagatgctcctgtgccacatcttcaaatccataatcatttttcaacggattcaggaggtaagctgctacaatactgtcaaagcacttctcctctgctgctccttctaatcctttcagataaggcagggatgacttcagatcaaacaccacaaaccgtccggcatgctttgccacatgtacaagtgcctccagaagttcctccatgctgtatccatttcctgccggaatacagtagatcttctctttcccaaacgaaattccaattccacctatctcagcatttcctgcaaagagcggaagtacatttctggtgtctttgtaaagaacggctcccactgtctgcgctttttctgcctccgcaaagattttcttaatttcttcttttcccacagcgatcacaaatgcatcttcaatcgaattctcactctgcacatcaaaacgattcagcagattcttgaactgcagtctctggaaatagacataagcttcctctgtataaagatttccaagcttcgcctcttccagttcatacgcaaaatccgcgtctacatcgattgtcgccagcaccttactcatttgtgcctgatcccagtattccaccagatttttcgatgctctcggcggcttcagttcggatgcatgcttgtaggcattttcaatagatccgtattctacaataatcttggtcgccgtcttttctccgactcccggcacccctgggatattatctgaagtatctcccatcaatgctttcacatcgataaattctgtcggtgtcacctggtatttttcttttacgtccactgcataataattctcgatctcagttccggtccgttttgtcttcggaatccggatctcaacatggtctgtagcaagctggagaagatctctgtctccggaaataatgaccacttccatccccattcgctcgcatcttttggacagcgttccaagaaggtcatctgcctccagcccttcctgctcgatcgtccggattcccatagcatgcagaacttccttcatcaacggtacctgctgtctgagttcttctgccatcggctttctcgtccccttatacgcctcaaacatcttgtggcggaaagtcggcgcatgcacatcaaatgcaacggtcagatactccggcttttcctcctccagaatcttgaacataatatttaaaaatccatatattgcattcgtatggagtccttccgcatttgtcagatccggaagtccgaaaaacgccctgttcagaatactgtgtccgtctatcaatacgattttgctcataatcaactgcctctctgtaagtctcatcacttacttctatcttttctatctattcgttcaaatatacaacatctcattatgacatttttttttgatattttcaatacatgaaggggtaaaaaagatcctcatcaaaattacagatatacgaaatgtgccacaataattgtgtatatacgaaaaaatacatcacgaatcatcgcaatgtacttttcatatcttttattcaattccagttaattatcaactgccggcagcgggacttgaacccgcacgcggtcacccgcaacagattttgagtctgcctcgtctgccattccgacatgccggcataaaattcatattttttaatcacgaaccgaaaataattatatcatacttatcttcggttcgcaagtattttttcaaaataaactatttgaaattattttccgagcttatccgcttcttccgtattcttcttaagttcctcataaaccgggaagcagtcgaaagttgcaaagtaatccatcggcgtctctgctctgcggatcagctgtgtacctccgtcctctttcagaagaacttctgcggaacgaagacgtccgttgtaattatatcccatagagaatccatgtgctccggtatcatggatcacaagcagatctcccatgtcaatcttcggaagctgacggtcgattgcaaatttatcattattctcgcacagagaaccagtcacatcgtaagtatgatcgcatggttcattttcttttcccatgacagtgatgtgatggtaggcaccatacatagccggacgcatcaggtttgcggcacatgcatctacaccgatgtactctttgtgcgtatgcttttcatggattgcttttgtcacaaggcatccataaggtccaagcataaaacggccaagctctgtgtaaatcgccacatcgcccattccagccggaacaagaacctcttcgtacacttttcttacaccttcaccgatcaccttgatatcgttcggttcctgatccggtttgtaaggaattcccacaccaccggaaaggttgatgaacttgatatgtacaccggtctctttctgaagcttaactgctacttcaaacaaagtacgtgcaagtgtcggataatattcattagttacagtattacttgcaaggaatgcatggataccgaactcttttgcgcctttggacttcaggatcttgaatgcctcaaaaatctgttcagttgtcataccgtatttggcatctcccggattatccataatgctgttggaaattttgaaaagtccacccggattataacggcagctgattgtctccggaatctttccgatcgtcttttccagaaaatcaatgtgtgtgatatcgtccaggttgatgatcgcgccgagcttatcagcaagtgcaaattcctctgccggtgtatcattggaagaaaacataatattttctccaacctgtccgacagactcagacattaaaagctctgtataggaagagcagtcacatccgcatccatattcttttaaaatattgaggatatatgggtttggagttgcctttactgcaaaatattctttatatcctttgttccatgcaaaggcttctttgagtgcttttacattttcacgaatccctttttcatcataaagatgaaacggagtcggatattcttttacgatttcatctaactgtgtctttgttacgaatggttcttttttcattctgttcatctctctttcgtctagtcgatggttgcaatacgcatcatattacttacagaacccttttcacgctgtacgctcggtgaaggaataccagctgtcaggacaacaatatctccactgtccacgcatttctttgcctgtgcaagatcaattgccccactgcagatatcatctgttgtatggaattccagagacttcaatcctcttacgccccagtagatcgacatccggcgaagggtacgttcgttcggtgtaattccaaggatttcctgtctcggacgaaggttggatacaacccttgttgttgcaccggatacagatggagtgatgatgcatcttgcattcaggttcgctgccgcaagtacagaagcatatccgattgcactggacacacctgacttcagatgatctccggctttaacaagaatggaatcatagtccagatgttcctctgtcgtctctacaatttgaaccatcatctggagtgcttccagagggtatttcccctgtgctgtctctccggaaagcataactgcatctgttccgtcgtataccgcattggcaacatccgtcacttctgctcttgtcggacgcggattacgcatcatagaatccagcatctgtgttgcagtaataacagtcttaaagttgtcattacatttctggatgatcattttctggagatgcggcacttcctctgccgggatctctacaccaagatctccacgtgccaccatgataccatcagccgcacggataatctcatcaatattctcaataccttctgcgttctctacctttgcaatgattggaatatacggagcgccgagttcttttaagtatgccttgatctcaagtacacactctgcatttcttacaaatgatgctgcgataaagtcaatatcctgctctacaccgaaacggatatcatccttatctttttctgtaatagccggaagacgaatggctacgttcggtacgttaacaccttttctttcgccaagttctccaccatttactacagaacagacaatctctgtctctgtcttgctctctacacgaagtccgatcaggccatcgtcgatcagaatggtacagcctttataaatatcctgtaccagtcccttatatgtgatagatactctcttattatctcctacgatatcttctgttgtcagagtgaaggtttctccttcttttaaagtaatcttctttccatctttcaggattcctgtacgaatttccggtccctttgtatccagaaggattgcagtgtttgtatgttcctcttcacgaagctctttgagcatatccattctgaacttctgttcttcatgatcaccatgtgagaaattgaaacgtgccacattcattccattctggatcagctttctcatcatttctctgtcgttggtgtttggtcccattgtacaaacaatcttggtttttttcattgtttcctcctcttattattcaatttgattctatgttagaactctacttcacatgttcgtgtgtgaaaagatggtcctggcaatattcataattcccgttacactttgaacaataacggaactccagtgtcggattgtcaagttccgtacgaccgcacactgcacatctgtgctttgcaccgcctgcatactgattctgcggacggcttatctgcttctggaatttctttctgcgggcagcctgtttcggactgtgtccacgcagattccggttgcagaaaaagaaaataataaagttcaaaagcgatgcgatgatcacgatccgtatgatcagaccgccctgcactgcgtctaccgcaagcagaaccacatccagaactgcaagccacttcatcttgattgggataatgccgtaaagcaaaagctgataatccggcatgatggatgcacatgcaaggaaaatggacatattgatatagtaagtactgtaaaggcttccaaatccggtaatgcctccgatcagtccattcacaataaaagctccaataactgtaaataatattcctgagaaaatgtaaacattgtaacgaaatgccccccagtagctttccagcgtattaccaagggaatagtataacagcatcataaagataacaaaaataatattgtcattcggtgggatgatcacccagcttagaagtcgccacacctgccctttcaaaatcagtgccggttccagtgtaaaataggtaagaagctgtggcatcgtaaaactcaaaagatatccgattgcataacctgcaagcagatacatcgtaagatttctaattgcatagcgcccgaacctgcgctccattttatctaaccagttcttcattcaaaacctccttccacgtatgttattttatcgtctgctttttactttgtcaattccattccacctctttactctcttttcacataatttacatcttttgttcacttccaggcacttttttctacaatgccatacataacttctgtttgtattttcgttggttctgtcgtataatgtaagatactgtagttctctgcgaactacatttaataggtaataacacagacaaattttttaattgtaataaggagtagttaaatcatgaatcagacagaattacataccctggggattgacatcggttctacaactgttaaaatcgcagttctggacagtaataatgatgttctgttttctgattacgagcgtcacttcgccaatattcaggaaaccctttctgatctgctgggtcgtgctatctacaagctcggtcagatcaaggtatctccaatgattaccggatcaggtggtcttactctggcaaagcatcttggcgtaccttttgtccaggaggttgttgccgtttccaccgctcttcaggattatgcaccacagaccgatgtagcgatcgagctgggcggcgaagatgccaagatcatctattttgaaaatggaaatattgagcagcgtatgaacggaatctgcgccggaggtaccggatctttcatcgaccagatggcgtcccttctccagacagatgcaaccggtctgaacgaatatgccaaaaattacaaagcactttatacgattgcagcccgctgcggcgtatttgccaagacagatatccagccgctgatcaatgacggtgctaccaaagaagacctgtctgcttctattttccaggcagtcgtcaaccagaccatcagtggtcttgcctgcggaaaaccaatccgcggacatgttgctttcctcggtggaccgcttcatttcctctctgaactgagagaagcgtttatccgtactctcaagctggatgacgaacacattatcgcaccaaagtattcccatctttttgcagccgtcggctctgcgctgaactctaaaaaggatgtagtcacctctcttggtgagatgcagaaaaagctggatgcccatattgaaatggactttgaagttgagcgtatgcagccgctcttttccagcgaagcagattacaatgaatttaagaaccgccatgcaaagcatcaggtgccggttggtgatcttgccagctaccgcggtaatgcctaccttggaatcgatgccggttctaccaccacgaaagccgctctggtcggagaagacggtactcttttgtactccttctaccatggcaatgacggtgatcctcttggtacgaccatcggtgcgatcaaggatatttacagccagcttccggaaggcgtacagatcgttcactcctgctcaaccggttacggagaagcgctcattaaagccgcacttcttctggatgaaggcgaagttgaaaccgtatctcactattacgccgcttctttcttcgaaccggatgtagactgtatcctcgatatcggtggtcaggatatgaagtgtatcaagatcaagaatcagactgtagacagcgtacagctcaacgaagcatgttcttccggatgcggttcctttatcgagacttttgccaaatccctgaactacaccgtagaggattttgcacatgaagcactttttgcgaaacatccgattgacctcggtacccgttgtaccgtatttatgaactcaaaggtaaaacaggcgcaaaaagaaggtgctgaagtatccgatatttcagccggacttgcttattcggttatcaaaaatgctcttttcaaagttatcaaggtatccgatgcatctgagcttggtaaaaaaattgttgtacagggtggtacattctacaatgatgccgtactcagaagctttgagaccatcgccggatgtcaggcaatccgtccggatattgcaggaatcatgggtgcttttggggctgcactgattgcaagagaacgctatggtttcaaagaatgtaaaaatacaaccatgctttccattgatgaaatcaatgaacttacctatacaacctcaatggcaaaatgtaacggctgtaccaacaactgtcgtctgaccatcaacaaattcagtggcggacgtcgttttatttccggaaaccgttgtgagcgcggtcttggaaaagagaaagcaaagagtgatgtgccaaaccttttcgcttataaaaatgaacgttattttggttacacgccattagatccatccgaagcaaaacgtggaacggttggtattccaagagttctcaacatgtatgagaactatccgttctggtttactttcttcacaaaactgggatatcatgtgttactctctcctgcttctacacataagatttatgaacttggtattgaatctattccgagcgaatccgagtgttatccggcaaagctggcgcacggacatgtacagtggctgatcaaccagggtgcagactttatcttctacccttgtataccatacgaacgtggtgaatttgccgatgccgacaatcattataattgcccaatcgtcacctcatacgcggagaacatcaagaacaatatggatccgatcgtacacggtgaagtagatttcatgaatccattcctcgccctcacaagcgaaaagacaatcacagacggactggtccgtgaatttacttctgcaaagaatcttccagcagaagaaatcaaaaatgccgctcatgctgcatgggaagaacttgctgcatgccgtcaggacatccgcaaaaagggtgaagaaacactcgcttacatggaaaagacaggaacccgcggcattgtacttgccggtcgtccataccattacgatccggaggtcaaccacggtatcccggagatgatcacctcctacggacttgccgttctgacggaagattctatctcccatctgaatccggtagaacgtccgctgattgttatggatcagtggatgtatcattcccgactgtacgcagcagccaattttgtaaagacaagagatgatctggatctgatccagctgaactctttcggatgcggtcttgatgccgtaacaaccgatgctgttgcagatattctgaccggttccgacaagatttatacctctcttaagattgatgaggttaataacctgggtgctgcacgtatccgtatccgttctcttctcgccgccatccgcgtccgcgagcagaagcatatggagcgcaccattcgtccggcaaatatcgaaaaaattccttttacaaaggaaatgaaggaaacctataccattttgtgtccgcagatgtcaccgatccacttttcactgattgagccagccttccaggaagcaggctacaaactggaagtactgaaaaatgataacaagcatgcagttgacatgggccttaaatatgtaaacaatgatgcctgctacccgtctctgatggtagttggacagatcatggaggctatcctttccggcaaatatgacaccgaccacctggctgtcattatttcgcagaccggtggcggatgccgtgcttccaactatatcggatttatccgccgtgctcttaaaaaagccggttacggacatatccctgttatttcaatcaacttaagcggacttgaaagcaatcctggattcaagatcacccttccacttgtactgaaaggtgtgtatggtctgatatttggtgatctcttcatgcgctgcctgtaccgtgtccgcccatatgaagctgttccaggctctgccaataccatgcataagaaatgggaaaagacagttatcgaatttatcaagaaaggctatccaagcagacatgagttcaagcgtctctgccgccagatcgtagaagattttgattctcttccattaaaagatgtcaaaaagccacgtgtcggagttgtcggagaaatccttgttaaattccttccagctgccaataactacctggtagatcttcttgaacaggaaggtgccgaagccgtggttccggatctgaccgacttcctgctctactgcttctacaatacaaactttaaagcagaacatctcggcatgaagaaatcaaccgcccgcatgggtaatctcggaatcaaggctttggaatggttccgcaagcctgccgttgatgcattaaaagcaagtaaacgcttcgatccaccatcacatattgaacacctggcttcgatggcaaaagaaattgtttctcttggaaaccagaccggtgaaggatggttccttaccggagaaatgctggagctgatccacagcggtgcaccaaacattgtctgcacacagcctttcgcctgtctgccaaaccacgtagtcggaaaaggtgttattaaagaactgcgccgccgtcatccggaatccaacatcgttgcaatcgattatgatccgggagcaagcgaagtaaaccagctgaaccgcatcaaactgatgctttcgactgcgcagaagaagatgtaagacttttggatatgtaaaaataataggttctaatgggacgaccagaggaatccaaaatactccccacgcattcagttgcactaaccattccgttcaagcctcttagggcgggaatcgtgttcagcaaaggcttccacgattcctgagtcttgaactccacagtgcaaattcatgtgtggggagtattttggatttctctggtctgtgtattggtaactttttttacatatgcaaaagttttttggatgatgagaactaggatttagggaattgcaggactttcttttgtaaaatcgaccaaacaacctttatttaaaaaaaacagcggactccttttcgggaaaatccactgtttttcacatatattaagcttcttcgacttctactttttcgccaagaattttatcaatacttaccagttttacgctgagtacgaatacctgtgctgcaacttccagttcttctggtgtcgggaaggacggtgcaattcggatattgctgtcttttggatcctttccgtatgggaaggttgctcccgcttttgtcaagatcagtccggcttcttttgcttttgctacgattgcttttgcacatccatccaacgcatcgaaggaaatgaagtatcctcctcgcggtgccatccaggaaccaatctcaagtccgccaagctcactttccagtacacttaatacggtgtcaaatttcggtcttaagatatctgcatgtttcttcatatgctgaaccattccatggatatcaccgaagaaacgcgcatgtctgagctggtttaatttatcatgaccgatggtctgtacggacatcatcttgcggatttccgcaaggttttcatcggatgctgcaattgctgcaataccagaacccgggaagctgatcttggaagtagaaccgaatttgtaaaccatgttcggatgtccttcttttttacattccatcaaaatctcgatcagataatcctgtttatcctcatacaaatgatggattccatatgcattatcccagaaaatacggaaatcttctgccgctggatttaatttcgcaaaacggtgtacggtttcatcagaataagtgattccctgtgggttagaatatttcggtacacaccagataccttttacagccggatcattctccacatactgctctaccagatccatatccggtccatccgacgtcattggaatattgatcatctcaattccaaaatgttcggtgattgcaaaatgtctgtcatatccaggtaccgggcaaaggaattttaccttgtcaagctttgcccaaggggtgcttcccatgataccatgtgtcatcgctcttgcaacagtatcatacattacgttcaggctggagttaccaaagatgataatattgtccttcggtacttccatcatatcagaaagaagctgttttgcttctttgattccgtcgatcactccatagttacggcaatctactccttcttcgcagacaagatctgatgtgctcttaagtacatccatcatccccatagaaagatcaagctgtgctttggacggtttacctctggacatatccagtttcagaccttttcctttaacatcttcaaattctttttccagtctgctctttaattcaagcagttcttctctactcatatctctatatgcagtcatcttgaaaacctcccataatcatcaactaatcattgtgtgtttcctgccgtactttatacttccgaaatctgccatctgcagtttctttcagctgttttgacaacatcaaaactcactacaagtagtaagtatataggaaaaatgatttttcgtcaactaattcttgcatataaatatgacatatcgtgatttttgttgatttaaatgtgtttttttgaatttttgtttttcatttcatgcatttttccattttaatgcttttcaaaaagagtagatcagatttatatgcagcatattttcttttctcctgcagtatgttttgctcttctgacaacaaaacacccggaaccattttcatgattccgggcaaatatatttactattttactaataatgattttccagtcatatctgctggctgctgcattcccatcagctcgatcagcgtcggagcgatgtctgcaaggcatccgccttcacgaagcttatatgcaggatctgcatttacaagaatgaacggaaccgggttcgttgtatgagcggtaaatggttctcctgtctcttcatcgatcagctgttctgcatttccgtggtcagcgcagataaacatctgtccaccaacttctttcactgcatcaactgcttttcctacacattcatcaacagcttcaattgctttgatcactgctgcttctacaccggtatgaccaaccatatccgggtttgcaaagttaattacgatcacatcgtacttatcagctttgattgcgtctacaagcttgtcacatacttcatatgcactcatctccggcttcagatcgtaagttgcaaccttaggcgatttgacaaggattctgtcctctcccttgttcggttcttctactccaccattaaagaagaaggtaacatgtgcatatttctctgtctcggcgattcttgcctgtgtcatattgtttgctgcaagaaattcgccaaatgtattcgtgatgccttcttttacaaatgcaaccattttatttggaattgtctcatcatactctgtaaaacatacataagttgtcttgatacgttctcctctgtcaaatccgtcaaaatcatccgcacagaatgttctggtgatttctcttgctcgatccgggcggaaattaaagaagatcacagaatctccgtcttttacagttgcaaccggtgtaccgttttttgtcactacaaatggtactacgaattcgtcagttacttctttgtcgtaagaagcctggattccttctgttgctgatgctgctgtgtcaccttcgccacgtgtaagtgctgcgtatgctttttctacacggtcccaacggttgtcacggtccattgcatagtaacgtccggaaacacttgcaacttcacctacaccgatttctttcatctttgcttctaactgttcaacatattctttcccagatgccggaggtgtatcacgtccgtcaaggaagcagtgaacatatactttgtccagcccctgtctctttgcaagttccaaaattccataaatatgtgtaatatgactgtgtacaccaccatcagatacaagtcccatcagatgaagagctgtaccgttcttcttcgcattttcacaggctgcaagaagtgccttattttcgaagaaatcgccatcagcgattgcttttgtgatcttggtgagctcctggtaaataatacgtcctgcacccatattcatatgacctacttccgagttacccatctgaccgtccggaagtcctacagcaagtccgcttgcatttccttttacaaacggatattcagccattaatttatccataaccggtgtgtttgcctctgcaataccgttgcctttcttttcatctctcagaccgtaaccgtctaagatcatcaaaactgttggttttttactcatcgtcttacactccttcattttgtcttaaagcgtttgatttctctttcagttaaatattgtacatgattttatatatgcttgcaagcacttgttaaaactttgacagctgaaaaacgcaggcatttctgcctgcgccttggtataattgactatttccagtttacaatcttaccaaaatctggttttaaagaagcaccacctacaagtccaccatcgatatccggctgagcgaataattccggtgctgtagctgcatttacagatccgccgtactgaatacggattgcttctgctgtagcttcatcataaacttcagcgatacattcacggatagctttgcaaacctcctgagcctgctctgttgtagctgtcttaccggttccgattgcccagattggctcataagcgataactgctgtcttagcctgatctgctgttacattctggaatccaactttaacctgctgacggatgaagtccattgtcacaccctgttcacgctgttcaagagtttctccacagcacatgatcggtgtaagtccgtgttcaaatgctttcagcatctttttgttcacagtctcgtttgtctctgcgaagtattctcttctttcagagtgtccgagaacaacatatttaacaccagcatctgtaagcatgttcggagagatttctcctgtgtatgcacctttttcttcaaagtacatattctctgctccaacctggatgttgcttccttttgcagcttctacaaccggaatgatatcgattgccggtacgcagaataccacgtcagcctcttctgtcacaaccagagatttgagtgtattcacaagctctactgcctctgaaggtgtcatattcattttccagttacctgcaataattttctttcttgccattgcaataatctcccttattttatcttaattacagacgctgcttatttatcgttagcagctgctacacctggcagttccttaccttcaaggaattcaagggaagctccgccacccgtagagatgtgagtcatcttgtcgccgtatccgagctggttaactgctgctgccgaatcaccaccaccaatgattgttactgcatctgtctcagcaagtgcttttgcgacttcttctgttccttttgcaaagttcggcatctcgaatgcacccataggtccgttccatacaactgtctttgcatcttttacagcgtcagcatagatcttgattgtctctggtccgatgtcaagtccttcccatccttccggaatttcgccagctttaacaactttgatatttgcatcatttgaaaaatcatctgcaattacgttgtctaccggaagaaggagttttacgcctttgtctttagctttctgaatcatgttcagtgcatattcacagtaatcttcttcaagaagagattttccaacggttccgccctgtgctttgctgaatgtataagacatacctccaccaatgatcagagtgtctactttatcgatcaggttttcgattacagaaatcttgcttgaaactttagctccaccaaggattgcaacgaacggtctttccggattgtttactgcatttccaaggaaatcgatttctttctgcataagatatcctacaactgctgtatcaacatatttggtaacaccaacgttagagcagtgtgcacgatgagctgttccgaatgcatcgtttacgaatacatcacaaagagaagcgagttccttagagaattcatctccgttctttgtttcttctgctctgtaacgtgtattttcaagaaggattacctctccatctttcatagcttcaactgctgcttttgcatttggtcctactacttcaggatctgctgcgaattttacttcctgtccgagaagttctgaaagtcttactgcaaccggtgcaagagaaagctccggtttcggttctcccttcggtttaccaagatgtgagcagaggattacttttcctccgtcagcgatcagtttcttgattgtaggaagtgctgcaacaagacggttctcgtctgtgatcttcccatcgatcagcggtacgttaaaatcgcatcttacaaggacttttttcccttttacattgatatcatctacagattttttgttaagcataatcctgcctcctgtttacatttcgtttaaatggaatgtgccgggcacatttccgtgctgagcgcagttgcttgcgacaatctgcgttttcacacgaatacacatcttgggcacatagtgccttttatttagcaggaagctccatcagaatttcctgttaaataaaagagcccggtccatgtagaccggacccttgcttgattctaactctggaatattccagtaagaatcaattcagcctgtccaaacaaacgttacggattaaagtaatgttccgaagtgtttgattgttcttaccatctggcttgtgtaagagttttcattgtcataccaagaaacaacctgtacttctgttgttccgttgtcaagcggaagtaccattgtctgagtagaatcgaagagagaaccaaatctcattcctacgatatcgctagaaacgatctgatcttcgttgtatccgaatgattcgttagaagctgctttcatagctgcgttgatctgttctacagtaacttcaccttcaactactgctgtaaggattgttgtagatcctgtaggggttggtacacgctgtgcagatccgataagttttccgttaagttccggaataacaagtccgattgctttagctgctcctgtgctgttaggaacgatgtttactgctgctgcacgagatcttctcagatcaccttttctctgtggtccgtcaagagtcatctgatcacctgtgtaagcatggattgtgcacatgataccagatttgatcggtacaagatcattaagagccttagccattggtgcaagacagtttgttgtacaagaagctgcagaaatgattgcgtcatcttttgtaagctgtgtatggtttacattgtaaacgattgtaggaaggtcatttcctgccggtgcagaaatgataacgtgtttagcacctgcatcgatatgtgcctgagcttttgctttagatgtgtagaatcctgtacattcaagaactacatctactccgatttctccccatggaagttcagctgcattagctttagcgtagattttgatttcttttccgtctactgtgatggagtcttctccagcagatactttatcagctaattcatattttccctgtgttgaatcatattttaataagtgagccagcatcttaggagatgtaaggtcgttgattgctacgatctcaaatccctctgctccaaacatctgtctgaatgcaagacgtccaatacgtccaaatccattgattgctacttttactgccatgatttagtcctcctaaagataaattgtattactgtatataacagttacatttttcttgataaatcttatcattgtttaagatttatcaactgtaatttattgtactaaattcagaacaaaaattcaatccccttttttcactttatttttctgaaaaccggggccctttttatgaattctgcataatatttaaaaccacatgcttcgagaatattgtcaactatgttaaaatcataccctacatgctctggtttatgtgcatctgcgccgacggtgatgatctctccccccagctttttgtatctttttaacacatccggatgcgggtgtgcaaaaggaaggccatacttcagtcctgctgtattgacttccagtccttttccgtgttcaataagataccgcaggatttcatctatttcatccgcaaatctgccgtaagaatattcctgttcccgatgttttccataacgtaccacataatccagatgtccgagcacatcaaaatccgctacagccctgatatcggctattgtctcccgaagtgccatccggtaggcctcttcatccgaaatcccctcaaagaactcaggataataaggatccttcccaccaaccacatgcatggatccgatcacaaaatcatacggatttgccgcggtaaatgcttttgctttcttcgcaaggtgtggctgaagtccaaactccacaccgatccggatatccagcttctctttatacttttccttcagtgctccaagctctttaaaataggtttccggatcaaacacaaattcaatatcatcacaaaaataatcaatatcttcatgatccgtaaaacagattgcttccagtcctttatcgattgctgcaagaaccatatcttccggttttgcctctgaatctccggaaaaataagtgtgcatatggcagtccgctctcatattttgccctccttgtcattcttcatgtgtaaatccacccggctttcccgcaaatcatttgttggattgcagtacggtcccaatataccaaaaaacagaacaattctgagctatcccagaattgttccgcctccaagtacataatctccatcatacagtaccagtgcctgccccggtgtaaccgctctctgcggtgtctcaaagatgcactctatctcatcttctcccgttttgcggactgtgcaccagtcccctttatggttgtatctgattttagcaaatacgcgcatctcaccttccagatcctctactgtcataaagttcagcttatttgcacggacccgcgtcgtcatcagatcttcattcgtccctatcacaacttcattcgtatccggacggatctcaagcacgaatgcctgatacccaagagaaagtccaagtccttttctctgtccgatcgtatagtggatgattcctttatgccgtcccaggatctttccatccggtgttacaaaattaccttccgggattttctggtcactttcttcttcaataaaagatgcataatcgtcatcggatacaaaacagatatcctgactgtccggtttgttcgcaatctgcaatccgatctcttttgcgatctcgcggatctggtctttttcgtattcaccgacaggcatcagcgttcttctcaactgatcctgggtaagattataaagcgcataggtctggtcttttgaccaggttgccgaatgccggatcgcatagcgtccgttcggcaactgttctactctcgcatagtgacctgttgcaatatagtctgctccgatctccatgctccgtgtaagaagagattcccattttacataacggttacacgcaatgcacggatttggtgtccggccatgcaaatattcatccacaaaataatcgattaccttctcctgaaaatccttcttgaaattcatcacataatacggaatgccgatctgtgccgcaacttttctggcatcatctaccgcactgagtccacagcatccgccgttttcttcctgtattttcgattcttcgtcctgccagatctgcatcgtcacaccgatcacatcatatccctgttcttttagaagatatgccgctaccgatgagtcgacaccacctgacattccgactaccactttcttttttgccattctcttttctcctgcagaaaattctaatactcttcctcttctgcttcttcaccttcactgatatcgttcttcggcttctggagtccttcgatcttgatcccgtgcttctctgcataatcccacagcgctgcatggattgcctcctctgccagtaaagaacagtgtaccttaaccggcggcagtccgtcaagtgcttccataacggctttgtttgttacctgcattgcttctgaaatatgttttccctttacaagttctgtcgccatactgcttgttgcaacagccgcgccacatccgaatgtcttaaattttacatcattaataattccgttatcatcaatatcaaggtagattctcataatatcaccacatttggcgttaccaacagtacccactccgcttgcgttctcgatttctcccatattacgtggatgctgaaaatgatccattactttctctgtatacattgtaaattcctcctaaagctgtattttctatcgaattatttattctgtttttttgcaaaatcttcataaagcggtgacattccgcgtaaatcgcttacgattgtcttaagctgatctactacataatcaatgtcttcttttgtgatctcttcattcagagtcaggcgcagagatccatgcgcaatctcgtgcggcagtccgattgcaagaagtacatgggatggatcaagagatccggatgtacatgcagatccactggatccacaaattcctgccatatcaagacggatcagcatagattcgccctcaatgaaacggaagcagaagtttgcgttatttggcagacggtctgtcggatgtccgttcagcttggtgtacgggatttcttccatcacacgttttatcagataatctctcatctcgcgctcttttgctgtacgttcttccatcgtagcgatagcacgttttgttgctgtaccgattccaacaatacccggaacattttctgtacctgcacgacgttttctttcctgtgccccaccatgaacgaaggaacggatcttcacgccttttctgatatagaggaatccgattccttttggtccgttcagcttgtgtccgctggcacttaacatatcaatatgacattcatctacattgatcgggacctgtccgaaagcctgtacggcgtctgtgtggaacaggataccatgtttgtgggcgatctcaccgatctctttgatcggttcaattgttccgatctcgttgttcgcatacattacagagatcaggatggtatccgggcggattgctgcttccacatctgccggatttacttttccgtattcatccacatcaagataagtcacttcaaacccacgctcttccaaataagctgctgtatgcaggatcgcatgatgttcgatcttggttgtgataatatgttttcctttattctgataagcctcagcggttgctttgagtgcccagttgtcagactctgatccgccggctgtaaaataaatttcgttgctctttgcaccaagtgcggttgcgattctttctctctgttctgccacaacatctttgttatgggatgcgaagctgtagatcgcagaaggattgccatactgctctgtaaaatatggcagcattgcttccagaacttctggtgcagtttttgttgttgctgcgttatccaaataaattaatttactcatctttttgtccttctttctttacttctttattcatttccacaagggtatttatcataatactgtctaccgtctgtgccatgctttcattgactttcttccagacatatttcgtgatacagcttccctggatctcgcagctgtcttccgaatgaagtgctgcacaagtcgcaggttccaggtctccttcaagtgctctgagtacatcaccaacagaaacttccgccgcatcctttgccagccgatatcctcctcccgctccacggatactcttgacgagacctgcctttttcagcttcgccatgagctgttccagatatcgttccgatatctcctgcctggctgatatactgctgatggaaaccggttcttctgcgccataacacgcaagatcgataaaggcgcgtaaaccataacgacccttcgttgagatcttcaatccatcaccttctctttattttttatatcccactgttttactaggatttcttgcaaattgaggatatcatctctgttatgttctgtcaaggctctttcttgcatatattttaaaacaaaaatgcctttggagcttctatgtcacaaaaacattttctcctgaaaggaacttttatccttactgtagtcggcattctcacccgtgtaatgggatttttttaccgtatttttctcagcagatctttccctgcagaagaaatcggtctgtatcagctgattttccctgtctacacacttgcttatgctgcaacttcagcagggatcgagacggctctggcgcgcctggtcgccgcctcttctgcaaaaaagcagtctgcaaaagcttattcttacctgaaagcagcactgctttgttctctttttctttccatctgctgtctttttctgttgcaaaaaaatgctgttttcctcaccacagtcatacttggtgatccccgatgcgcctctctcatcttcctgatagcatatgcacttccatttgcagctctgcacagttgcagctgtggttactttctggggctcaagcagatccggcttcctgccctctcccaattatttgaacagctggtccggatcttttttgttatcttcctctatacagccgatgctcataccgcttttacaccatctgtcgcaattgctgtcctcggaattgtcggtggtgaaattgcagccgcttttctttgcatccataagctcagaactgccgggcaacctttctccccacaccgggagccggctctttctgctgttcctcccctgcttttttctgcccttccactgaccgcaagcagagtccttctgaatctttttcagagtctggaagcaatttctattcctcttgccctgcaaaagtatggaatgagtatctccgcttctcttagcacctacggaattctgaccggaattgcccttccctgcattttatttccatctgccctcaccaattccatctccacaatgctcctccccgaagttgccagtatgcaggatgctcagaaaaagcatgctcttccacagcttttacggaaagttatttttttctgcctgtttcttggttttgcctgcctgctatttttctttaccacatccggctttatcagcagacggatctttcatacaccagaagccggaaattatatcttaacactagcatttatctgtccttttctctatagtaacaccgcactgatcagtgtgttaaatggtctggatcttgccggaaaaacttttctgatcaatctgttcaccctggcagtacgaatctgtagtgttctgtttctgattccgcagttcgggattcttggctatctgtgggcactgcttgcaagccagcttcttacatttggctgctgcatgtttctcctgataaaacaagggcgataaaaaacggcagaaagtcctctttaccgaattgttcagtaagagggttttctgccattttctatcaactgacgctaaaatgtggctgaacacattcctgctatgtaagaaccttcacaaaccaacggacaatcccagggtttaaatacacctcagacaaaattcccgccacgatcatcataacagtaaatcctgtttttgttccattccattcactttgcggataacgataataataccggatcaatagaagatatgccggtacataaaaaatatattgcgggaaaataccggcaatacacaacagcattccgcaaaggcccatccttaaaactgccgccacagacagtatcccggctgcaaagcctgtccaaaggaggattccggctgctgtcagtctgcgaaaccccagatttgccacacagaccgctaacgccagaggcatcactctccatctgatcagataccacaggtaatcttcatttataattttcacctgtgtatactgatttagaaaatattcatggaaaattccagtcatcgtaacataatttttcgcaataaaattagcatataagatacccgttccaaaaccgatcagatatagcatgggcagctgatatttcttccgataaaattccacattccggcctccaataatttcacatagttcattatatgaccggagttgtcaattatgcgttcactttatctgttatactttgcatcataggcaaggatagcagctacagtcttggaatcttcaatctttccttcaaagatcatctgctttaattctttaaccgtatgtgcctctacattcacaaattcattctcatccagatgctgatgggtacggatcaggtttcgtgccacataaacttcgattttttcgttgcaaagtgctacagttgttcgaagcgtgatcagccattccagatcatcactgtgatatccggtctcttcttccaattctcttgctgaacagtctcgtccctgttcatccgcttggtccagccctcctgccggaagctccagtgtaaagcggtccagtgcattccggtactgtcttaccatcaggagtctgccgtcatccatcacaggtattacagcagcagcccctttgtggtggatatagtcccacacctcatgatttccattggaaaactccatataatctttgtatacatcaacaattgttccctgatataccctttctctttttacacgtttgatttcttttttcatccgttttcctcttccttttcacacaactatgagaaacacgctccgcgagtttttcaagttatcgcggcagtcgccaaggtctcgtgcaagcgcggactttggctcgttgctcgcgtaaattaaatacagccatccaaaagaccgaatcttttggacggctgtcgttttctgattatcgtgttatttagcataatctgtaacacgggattcccggattacatttactttaatctgacctggatattccaattcatattcaatctgttttgaaatatctcttgccagcaataccatatcatcatcagatacttgttctggaactaccattacgcgaatctctctacccgcctgaatagcaaatgacttctcaacccctttaaactggttggtaatatcttctaactgttttaatctgtttgtgtatgtctccaaggtttctcttcttgcacctggtcttgcagccgaaatcgcatctgctgcctgaacaacgcctgcaatcagagactgtggttctacatcaccatgatgtgcttctaccgcgttgataataagcggcgactctttgtattttctacaaaggtctacaccaatctgaacatgtgaaccttctacatcgtgatcaatcgatttaccgatgtcatgtaaaagacctgcacgctttgcgatacggacatccagcccgatctcgcccgcaagcaatccggatagctgagcaacctcgattgaatgcttcagtgcattctgaccgtagctcgttctgaacttcatacgtccaagaagacgaatcagttctggatggatgccgtgtacaccaacttcaagtgctgctgcctctccttcttcgcgcatcatagtctctacttctttctgcgctttttcaaccatctcttcgattcttgcaggatggattcgtccatctacgatcaaacgctccagtgcaattcttgccacttctcttcggattggatcaaatccggaaagaacaactgcctccggagtatcatcaataataagctctactcctgtcagtgtctcaagagtacgaatattccgtccctctcgtccgataattctacccttcatctcgtcacttggaagctgaactaccgagatcgtagtttcagccacatgatctgccgcacatctctggattgcggtgacaacatactctttcgccttcttgtcagcctcttcctttgcacgtgtttcaagctctttcaccatcttggcagtgtcatgtttcacatcttcttcaacagtttttaatagataatcctttgcctgttcggaggtaagtcctgagattctttctagttcctgtactcttttctggctgagttcttcaacttcagcctcccgctgcttcatcgctgtctcttttgcagtaaatgcagtctctctctgctcaattgccgcagatctcttatccagagattcttcttttgaaagtacacgcttttcataacgctgaagttcagctctgcgttccttagtctctttttcaagttcattctttgtcttgatggactcttcctttacttccaaaagtgcttccttcttctttgtctctgctgtcttcaaagcatcatcaataatttctcttgcttttacatcagcgttcccaattttagaatttgcatcgttcttcaacttggaaacagtaacaaaataagtaaccggcattactactataagcgtaacaactacagcaataattataggtatcagcacaggagcacctccttatttagttttcattgtacaaatacaacacttaaattctatactgttttcacaaatatgtcaagcattccaatcgcaaacttgtattacttgacggatatcttcgtaacgaaatcctttccgcaccaaatatccatatattttctgcttttctttcggatctgtacaggcaaagtcccagtgttttttgcgaagaagctcccggattgcttcctgatcggaatgctcttcatacatctcttccatgatctcttctgcccggttcatatccacgcccttctgtctcagaagggcataaatctcccgtctgctctttttatctttcctgctgtctataaagttccgaatgtaggcgtcatcattgatatatccaaatgatttcacataggcaatcgccgcttcggtgatctccgatggatagccgcccaactttaatttatctctgagctgggattcagttcttgccatgtcattcagcaggtgcatcgcacgaagctttgcccgcttcaaaaggacttctttgatctttgcataagtatcctctgtcaattcacactcttctttcaggtgaaaacgggacagttcgcctttgtaaaccacaaaggcgaactgctcatcaacagatacccgatactttgtctttgtaactggctcgattcgggtaattctcatcatatgttttattcttcctcatccatcacttcttcagcatctgccggagcagcctgtgccggttcttctgcttcctgcccttctgcaccgattccgtaatgcgcacggactttttcttcaatctcttccataatctccggatgtgctgccagataagactttgcattctcacgtccctgaccgatcttttctccgttgtatgcataccatgcaccactcttattgaccagatcaatcttcgtcgcaagatccaggatatctccttctctggaaattccttttccgaacatgatatcaaattctgcttccttgaacggaggtgcaatcttattcttcacgatcttcacgcggacatggttaccaaccatctctccgccctgcttcagagtctcagttctgcggacatccatacggacagatgaatagaacttcagtgcccgtccacccgttgttgtctccggattaccaaacataacgccaaccttctcacgcagctggttgataaagattacaacacagtttgatttactgataaccggtgtcagctttctgagtgcctgtgacatcagtcttgcctgcagacctacatgtgtatcacccatatcaccctcaatctcctgcttcggaacaagtgctgcaacagaatcgactacgataatgtcaatcgcaccggaacgtaccattgtctcagtaatctccaatgcctgatctccgctgtctggctgtgaaatataaagttcatcaatatctacaccgatattcttcgcatataccggatccagtgcatgctctgcatcgataaatcccgcaatgccgcctcttttctgtacttctgcgatcatatgtaatgcaactgtcgtcttaccacttgattcaggtccataaatttcaataatacgtcctttcggaacgccgccaacaccaagtgccagatccaggctcagagaaccggtcggaaccgtctcaacatgcacctgtgccgccggatcacccagcttcataactgctcccttaccaaaatctttctcaagctttgcaattgctgcgtctaatgctttctttttattctcatcattcattgtattattcgccatcattaatctccttatcccagattcttcgcccacgctctccatcgaacgaatgtttgttctggttctatattagtacatacgttctggtttgtcaactacatttttaaatcagatccacacgtctcaccttccccggagaagaaaccgaacccctcccgaaaacctttctcgcccagatccccaaagcttctgactcccccatcataccacatctcccccttcccccacaaccagaacacttcttctcggaagccattgctgacataattttcgcattcggaggctcatcggaatgccctgcacaactaaatctgtccggtttattttattaaaaacgcgtccgtcttctattttcccgcagaccgcccgtcctgcaatctaaagctcaaacacctcaagatcatccggtacaaacaacttcccgtgatagtactcccgtccttcccgcgtataaagctctttcctctccttaagatgcatctcttccgtatgatacaagatcaaatgcggaatctgaagctcctcggcaagctgacatgcttctttcacagtactgtggtgcttttcataaggcttgaacttatctgcttctccatacaggcagaacgcctcatgggtcagccagtcgctgcctttcacaaattcataatctttctcattgtacggttcgtcaccgcagcaggtaaacttcactccgttcggaagcagcatcgtaaacccgaactgctttgccttcgtggaaaaaatatcgaaaaaggtgaccggacagccaaggatttcctttgtctctccgtgatgcaccggcacaaaaagaatccggtcatcaaaatatttcgtcacctttttctggatcgtaagctctgcgatcttgcggattgatcttgccagctcttcatggcagtagatccgcagattcccctcatattttccctggccgatcttcttctgcccgatcatccgtatcagccagatcacgcccagaagatgatcgatatgttcatgggtaataaaaatatcgtgaatgtcttccagctggatcccggtgtcttttaacacctttaaaatacggtttccgccgccggtatccaccagaaaatgcctgtttccatccgagagggcaaaacatgtattatagcattccgttactgttgcatttcccgttccaagtattgtaagcttcatccgacattactcctgtctcatttcaactacttcacctgcacatttgtaaatacttcctcccggaacaaatcctctcaccgaagaaagtggataaatattggtatgcggtcctactacacttcccgggttcagaatggttccacatccaacttctacatggtcacccagcatcgcgccgaactttttcataccggtctcgatatttccttccggcgtctttacaaccaccagttttttatcggatttcacattagatgtgatagaacctgctcccatatgtgacttgtatccaaggattgaatcccccacataattataatgtggaacctgtactttattgaagaggaccacatttttcagctcggtagaatttccgacaactgccccttctcctacgatcgcatttccacggataaacgcacagtgtcttacctctgcgtcctttccgatgatcgccggaccgccgataaatgcagtcggtgcaacctttgcggatctggcaacccacacattttctccacgtttttcatactcttcttccggaagagacgcacccagttccaggataaaactgctgattttcggaagtacttcccacgggtaggtcactccttcaaacaaatcctttgcgatcgtctcttccagcgtatacatttctttaaccgtcatttctttcattctttctttcctttcgatgctctgcctttggtttcttttttataaaatgctgctgccctgtcatagcagcttcttaactgatactggttattcagtcccagtactccgttggttctgctgacaataaaatgatccagttttgtcatatattcatccgatgtaatttctccctctgccacatagttaagccccttttcccagcttgccgtcagctccggattcagaagtgaacggatagaattcaacaccacatcatagatcatttctccaagaagcgtcggtgtgatcacctgcgtctttttattcaatgccagatatttgatattgaagagctttttcaggatctccgccctggtcgcactggttccgatcccgcttcctttgatctgcgcacgaagttcctcatcctcgatcagctgacctgcattttccatcgcaaggatcatggaaccggaattgtatctcttcggcggtgaagtttctccctctttgatatccagtgatttcacatccaggatatcacctttttttaacttctggatggatgcaaaaaatgcggcatccagatccacattgttatcacttccatctccttccgcgtcatttccatttgcatttttctttggtgcagggacccctgccaccttcagatatccttcttccgcaagtacacggaagttggagaaaaactgttcttttccgatctgtgttaccaacgccactttctgataaactgccggaggatagaagatactcagaaacctccggacgatcacatcatacacatgatgagctgttgcagataccgaattcaatgctgaaagtccctgtcctgtcgggatgatcgcataatgatccgtgatctgcttgtcattgacataacgcgtctttgccaggtttttatatgctccgtaatgcagaatatcctgcatatatggtgcagccatctggtatttactcagcccgttcaggttctttgtgatctcctttgatactgccgtcgaaagcactctggcgtctgttctcggataggtgacaagcttcttctcgtaaagctcctgcacaatgcggagcgtttcatccggactgatcttgaaccgtttggagcattcgttctgaagttctgcaaggttaaacagaagcggcggattctttttctcttttttcttttcgatggatacaatccggcaggtaagaggggatgttccctctttcaaaacagcgatcagctttttggcctcctctttctctttaaatccattctctttgtagagctttggagactcaaaataagccgaacctttcactgcacgccactcaccggtaaaagtatgtccgtctacatttaccgattcaatcacacgatagaacggcgttttaacaaattcacggatctcccgttcccgccttacgaccattccaaggacacaggtcatcacacgtccgacagatacaaccgtgtatttattcccaagataatttgaaatgctgtttccatatttgagtgtcagaagtctggaaaagttgattcccatcagataatcttccttcgcacggagataagccgaagctgacagattatcgtattctgacagatccttcgcctcacggattcctctgaggatctcttcctccgtctgggaatcgatccacacacgccggcgttctttcccttttacgcctgccatctgttccaccagacggtaaatgtattctccttctcttcccgagtcggtacagacataaatccgatctacgtccttcctggtcagtattccttttacgatctcaaactgcttctttactcccggtatcacctcatagagaaattcctgcggaatgaatggcagtgtctgcaaagaccatctcttatacttttcatcatatacttccggataactcatcgtgacaagatgaccaacacaccaggttacgatcgcctcatctgattccagatatccgtcttttcttttcaaattcaaatgcagtgccttggcaaattcctgtgccacactcggcttttctgcaatatataccgatttacccatataataattttgtactcctgtattttcacgctatagcaactctcacagcgtttaaaaagtgaagctgataccagctccacttttttatcatatcatattcagaacataaaacaaattattttcttcgaaaaatcttccggattttatcaacgaagctttgttttgtccgtccttccggatgtctgacggtgattgcttcacgcataaaatattcctgggaattgacttttgaagttcctttttctttcatgtagtatttgccgtcactctttaattcccgcgcttttacattgtccgcaagcatgatcttcagcatatgtgtcagctgtttcctgatagtttcatcgtaaaccggacatgccacttccacgcgtttttccgtattacgcgtcatcatatctgcggaaccgatatagattttctgatccgctccggttccaaaaaggaaaatacgcggatgctcaagataacgtccgacaatactggtcacacggagattctctgtgtaccctttgactccaggaagaatacagcagatcccacggacgatcagatccaccctcacccctgcatttgatgcctcggaaaccttctgaataaaatctacatccgtcacagaattcatcttcatgatgatccgtccgttcgttccctttttgatctcctcgtccatcagtgaaagcacctttggtttcagactggtcggtgaaacaataatatgctgatagcttccattgagattgccaatggacatattcttgaagaagacggctgcatcctctccgattcccttatccgctgtgatcagcgacacatccgtatacatcgtcgctgtcttttcattgtagtttccggttcccacctgcgtaatgtattcgatattgttgcggttccggtaagtgatcagacagatcttggaatgcaccttataaccttcaaatccgtaaatcacacggcatcctgcttcttccagacgttcggaccagtcaatattgttctgctcatcgaatctggctctcaactcgatcaaaaccgtaacctctttgccgttctcggccgctgcacataagtactctaccagccgtgccttctttgccagacggtagattgtgatcctgatcgtaagaacggtcggatcataagccgcttccttgatcatacgcagaaacggatccatactctcatacggataagaaagaagtatatcttttttctttacctgcggaatcacttttccatccgtcagatagcgggacggctgcggagtaaacggttcgtcgatcagagaacgtttcagcgatgccggaaccttatccataatcgaaaaaatataatccagcttcatcggcatcttggtccggtagatctgtgccggtgtgatcttaaatttgtcacagaaatacttttccagttccttatccagcggctccgctgtctccatgcggaccactgccattctgcggcgcttgtgaagggtttcctgcatcagcaggcggaaatcatcattgatctccagtgcctcatcgtccggcgacacatctgcattccttgtcacacagatataattcttgttcgatacctcgtatttgtcgaacaccacatccagatattccatgatcaccttttccatacggatataacggatatcatggcccggaagatataaaatgtctgacacaaactgtggaaccggtacgattccaatcatggaagttccattctgcttcagacttgcgatcacatacagttccttattgagcagatgtgggaatggatgattggcatccacgatctgtggagacaggatcggtaggatctggtctttgaagtactttttcacatacttcttttcctgctgctccagctcttttatcgatagtccacagacaccgtatggattcagcagcttcttgatctccgagtaagtcttgtcccgctctttatacaatggtgctacagccgcaaagattgcatccagctgctctttcggattcatccccgaacggctgtcgatcgtgctgttatccgtaagcgacatatcatacaggcttcctacgcggatcataaaaaattcatccaggttgcttgtaaaaatggatacaaacttcattctttcaagaaggggtactgaagaatcctttgcttcctccagtaccctctgattgaacttcagccaggacagttctctgttctgtgtatagttctgcatttcttttttcatattagcccaccttcactcttcctttacactggtataatttcattctaccactgaatcagaagaaagaaaagttaacttcttttaaactttcctgcaaaagctatttctttgtgataaagccttttgcagtcagtgtctcagcacagagaacagctcctcctgccgcaccgcggactgtattgtgggaaagtccgataaatttataatcgtaaagggaatcttctctgagtcgtccgatagaaattcccattccgttctcataatctacatccagtttcacctgcggacggttgtcttctgtcatatagcggatgaactgcttcggtgcactcggaagctctgcttcctgcgggaagcctttgaaactttccagtttttcgatcagctgctctttggttggtttcttttcaaaattgataaatacggcagcggtatgtccgttaagaaccggtacacgtacacactggcatgtgatcttcggagaatctgcttttacgatctgtccattttcaactctgccgagaacacgaagcggttcctgctcgctcttttcttcttctccaccaatgaatggaatgatattttctaccatttccggccagtctttaaaggtctttcctgcacctgaaattgcctggtaggttgtaacaaccagttctttcggcccgaattctttccatgctgcaaggcaaggcgcatagctctggatcgaacagtttggttttactgcgataaatcctcttgtagttccaagacgctttttctggtcttcgatgactgcaaaatgttccgggtttacttccgggattaccatcggtacatccggtgtccatctgtgggcactgttattagatacaaccggtgtctctgtctttgcgtatgcttcctcgatcgcacgaatctcatcttttgacatatcaactgcactgaatacaaagtcaactgtctttgcaacttcttctacttcgttgacattatgtacaacgatcttcttgactgcttccggcatcggagtgtccattttccagcggtctccgactgcttcttcatatgtctttcctgcggaacgcgggcttgcagcaagtgttactacctcaaaccacggatgattttccagcagagcgataaatctctgtcctaccattcctgttgcaccaagaatacctactcttaatttctgatccatttttatgtcctcatttcctgttttgtctttttaatgcgcacatttgtacgcgcgatttgtatatcataacgcattttccgacatttttcaaccctgacaattgaaaaactatgtctacttattaacgctcatgttactgtttccagcacctgtgaccagcaatgctcattttccttataacgattagcactcttccagatacgcttcgtgaagcgcgatcacccttttcatagcttccggtccaggtgcaccgatcgtatttctcttattgacacaggtctccatgctgatcgcatcataaatatcttcttcaaataccggagagatctccttatattcttccagtgacatatcatctaacgcaatcttcttatcgatgcaataaagtaccagctttcctacgattccatgtgcatcacggaacggtaccccgtgatttaccagatagtcagctgcatctgttgcattggtaaatccgtgtctgcagctttccagcatacgttctttgttgaacttcatggttgcaagcattccggtaaataaagccaggcatcctttcacggtatcgatggcatcaaataccagctctttgtcctcctgcatatctttattgtaagcaagcggaattcctttcattgtagtcaggatcgaagtcagtgcaccgtatacacgtcctgtctttccacgaacaagttccgcaatatccggattcttcttctgtggcatgatactgcttccggtgctgtagctgtcatcgatatcgacaaactggtattcattggaattccagatgatcacttcttctgagaagcggcttaaatgcatcataatcgtagatagagcactcatcagctcgatcagataatcacggtccgataccgaatccatactgttcagtgtcggtccgtcaaatccgagaagctctgcggtgtatgctctgtccagatcataagtggttcctgcaagtgctccggatccaagcggacaggtattcattcttttgtaaatatctttcagacgcatatggtctcttttgaacatttcaaaataagcacccatatggtgtgccagtgtgatcggctgcgctttctgcagatgggtaaatccaggcatgatcgtctcggtattgtccttcatgatcgcaagaagttcgcggagcatatccacaaccagtccctgcagtgcggtgatctcacttcttgtataaagcttcatatccagtgcaacctggtcattacggcttcttccggtatgcagcttctttcctgcatccccgatccggtcgatcagatttgcctctacaaaactgtggatatcttcgtattcctctgtaatctcaagctttccgttctctacatccctgcggatgctttccagtccgtccagaatctgctgcttctcatcgtctgtcaggattccctgctttgcaagcatcataacatgcgccttgctgccctggatatcctgctcataaaatcgtttatcaaatgaaatggacgcattgaaattataaaccagtttgtcggtttctttcgtaaaacgtcctccccataactgtgccatagctttccctcttttcttcaacgtaattctgtgctttagtgtaccatagaatgtcggattctgtaaagttcccctcttaacttttcacagaactttcctcttcctcccgaagtttcttttcccgttctctctgatttttggaataaatacagccacaatagtcctggcggtaaagtccgtaaatctttgacagctcggttgaacgcttatatccatttctctttttaaaatccgaaaccagataagccactccatattccccggcaagccgctcaccaatctcattcagcttctgtgcatttttcagcggactgatggaaagggttgtggtgaaataatcatatctgccttcttttgcaaatctcgcagcttcccggagtctgagctcataacacctgaagcaccgctctccaccttccggaatcatctccagtcccttcgccatctcgtaaaatttttcactgtcataatttcccgcctgaaaatggatcgtatgtttcgccggaagctcacggatcagcttcttctgttcgtggatccgtttttcaaattcggattccggaaaaatattcggattgtaataaaaaaccgtaatctcaaaatattccgacagatattccagcacataactgctgcatggtgcacaacagctgtgaaggaacagacgtggaactttcttttccgatacgatctgttctatctttttatccagttctttctggtaattctttttctgcatctgttcatctctcctcatattgcagatttgtttcttattatagtgcagctgttctcttcgcacaatatcttttctgctctgtttttctttttccgctccattccagccagatgcacacacgcttttttttatttctcataaactgtaagtaaaagacttatgatcgtttctgtatctggaggattatcatgcaatatgcactggaactgaaaaacgttcattatgcttaccatacactggaaggagaaacctacgccctgaaagacatcaccttttcggtccgcgaaggggaatttattgctctggtcggtccctccgggtgtggaaaatctacactgctccacctgattgcgggtcttctcaccccggaaaaaggtctcatcaaaataaacggcagctatcatccggacaacacttccggcatcggatatatgctgcaaaaggatgaacttcttgagtggcgtaccatctatcagaacgttcttctcggtctcgagatccagcatgcactgactgcccgttcccgcgcactggcaagagcctttcttacacaatacggcctgaatgcctttgcaaatgcaaaaccatccgaactttccggaggaatgcgccagagagccgcgctgatccgcacgctggtcctgaagccggatatcatgcttttggatgaacccttttctgccttggattatcagacccggttaaatgtcagtgatgatatcgggcagattatcaaaaaagagaaaaaaacagcgatccttgtcacccatgaccttgccgaagcggtcagtcttgctgaccggatccttgttctcacaagccgtccggcaaccattgggcagacggtcaatgtttccttttctgatccgggactttccccgcttgcccgccgcaatgccccggaatttaagacttatttcaatctgatctggaaggagctgaacccggatgaatgaactttcaaaaaaccagctgcattacctgaatatgcaccgcagacataaacggatcattgctgtttccagagtctccatcttgctgacattcctctttctctgggaattttcggcaaatacaggactgatcgactctttcattttcagcagtccttcccggattgccctgtgttttctggaaatgaccggtgacggcagtattttccgtcatatcggagtgactctttacgaaaccctggtcagttttatcctggtaatcttcttcagcctttttgtcaccgtccttctctggctctttcggaagctttcggaaatcctggagccttatctggtcgtcctgaacagtctgccaaaatctgcgcttgctccgcttctcattgtctggctcggcgcaaaccgcacaacaattatcattgccggaatgtctgttgcaatcttcgggagcatactgaacctctattccgaattttccgaagtagacccaaataaaatcatgctcatctacactcttcacggaaaccggctccatgccctctccaaggtagtgatcccaagctgcattccggcgatcatcagcaccatgaaggtcaatatcgggctctgtctggtgggcgtgatcatcggagaatttatcggcggcagggaaggacttggctatatgatcatctacggcagtcaggtcttcaagctcgactggctgctgatgagcatctgcatcctctgcgtgatcgccatgctgctctatgctctgatcggactgatcgagaagtggtatctttgccggtgtaagatttcctgatatttatcagaaacttcacagagaaagtctcttctttctccctcgctttttcaaaaaggaaccatacttttcagatcatttctggtatgctccccgtcaagaggacaataaaaaataataaatttttgtatcgtcagccatgctatggctggcgatattttatgctgcttttgtagattgctcatgatatttcattggtccattgtcaatacagtgggcaactctaggcatactctgcttcatatgatgtttttttaatctagtataaaactgtgcgcttgtatattgaaagcctcgattagaatgaactaatgggtgtgcatctacctcctgacgaacagcctcatcaaacgtgtccataactaatggattatcattatgatcgctgattttaaaggaaacaatccttctatcatataaatctaaaatagcactcagataaactttatgaacttctattccgttgtagtatttaaattcagaaacatctgtaagccacttttcattcggtttttcggcatgaaattcacggtgtaaatagttttttgctatgtgatcaggatttctgtctcctctggtacaactcttaggtttccatttaatatttgattttatatcgtatttcctacaaatacgaagtactcgtttatcattcacatgaattcctttatgtccatctaattcatcacgaatccttcgatatcccatatctggatgctggttatgaatcctttggatttcagtggatagtctttcgtttcgaagttcattattacttttcggatattttacccagcggtaatacgcagaacgtgtaacattaagatatttacaaagtctttctatgggataatgcttagatatttgagtgccattgcaccataattcttatcatttgcaagacaatctgttactatttttaatctctcatcaagtgtagtgttctttgcttttttcatgtaagcacctccagtggaggtttttaatattccaccagaattatacaccttaatccaatcggaaagctgtctgtgtgaacgaattccgtattttgtgcaaatatcctgaagagatccttctccgttaagataatcatttatagcagatatttttaaatcttttgaataagatctgtttttcggttgattgagtaatccagttgatccagcatactgataaatagaaatccaatttcgaatactatgatgatcaactcccaattcttttcctgctttccgtatgccaatttctcctgcaaggtagcgttcgactatttttactttttctactggttctatcttactctttctgaacatgaaaatacccccatataggacttttatatttcattgtcctatatgagggtagcatatctttttctgcctataccgccccaaactgcagataccacactgccatcttatctcccagaaaaattgcagttgcaagtccaaacgcaagaaatggtccaaacgcaaactgatctgttttattcagcctctttcgtaccagcatcagtgtcacataagcacctcctgttataatcccaatacacattgcacatatcattgacgcgccaccaataagcaatccgcttaccgacatcagcttgatatctccgcctccgaaagcccctggaattgcaagtgccagcaccagcatcggcactgatatgattcccataccggtcagtcttgtagcaattcccatctccggataaagcataaagtccaaaaccgcaagtatcaagatcataatatgaaatcgatcataaatcatctgtatatgccagtcaaccaaggcaatcacaaacagtattcccaaatatataaaaaaaactgcgcctcttagtgaaatcacacccattttcccgcaaccatatacaatcgcacaaccggtcatggatactccacctgttaattccactaagaaatatcttgcaatcctcttgctctttgcacatattgcgcttttcccgtatgttaatttatcgatgacaatatgtaagaagctgaagatgccagctccgaaaaagaaccttattatccataatatgatttctaaaaccacaaacatcctctcataattaaatgatttgttataaattataacagttttttcgcaaaaaaggtactgtttttaatgctttatttaatttttctgtcacaaaattgatcatgacaatattttgaaacctgccggagaccttttaataacaggaaatgcaatttcctgttatagaaaaaacggaaacaaaaaatggatcaatctcttttgtgagaatttgatccatttttaccgcatctaaatcagttgtcccagcaccggaagccttttcagataaattcttccggaaaatgcaatatgcggcagttcataaaacatacaatgcttcggacagattggctgatacaatggatccgctacaatgatttctgcatctttcaatgcttcttccatctcttcttccccacagatccatctgtcctgtctgcaaagcagaccttctgttttttccagcgggcagagaacttccaccggacagccatatttctgttcgatccctgctgccagagattccatggtcaccggttctccgatcagagtcactttcttttgtctgcctgccgcttcaggcttctttatttcttctcccgatgccggatttctgtttcccttctgctccatgatttcttcaatttcaccctgcatccgatccttcagatatggtatctgctctttttcttccagtgctttcgcaatccgctctgtataagaaccaatcggcgttccaaccacatacggggttccgaacttttcttccagtactttcgccgcacgaagtccgaccgaagataccaccagattcacctctgcttctcctgcctgcaaaaatgcatccagttcatctcccattgcccaagtagacagcaccttccatccacaggctttcaggttctctttcagcacctctacatgagataccggtccaaagtccagtggtgtcaccccaagcagattgacggtgcgtgcctgaatccgtcctgtcttttccccggtaaatctttttgcgatctcctctaatgcaattcctgccccatacacataatcatgcattccgttcgtcggtactgcaaatgcaggaatcccggtttcttcttccagtacctgtgccagtgccggaaaatcggttccattcatatacggaattggggatcctgcaagggcaataaatttcggatgcagctcccttgctgcctctttgatatcatccagaaatttttcatcatttcccatgatcgcatcaatttctgtcagaccggaaatatagatcagactgtcctgatcataccagcggatctcatcgtgagtgttgtaggtcgaattgcatcctgacgggtcgtgcatgactgtcatgccgccaagctcataaagtgcagaacacacaccggatacatccgctgtataaattggtatgattcgataagattgtctcatatacagctttcacacccccatccttttcgcacaaccagatcttccgtgtctttttcttcggtaaatgcttcgaccataagctctgccgtcctgcggatcccgtcaaatccgtaaagaccgccgccctgtaccatattgacaaaatacggacttcctgtaaaccatgccgccttctgtccgatcgccagtattttttcatccgatgttctcggaagcacacgcattttcacctggatcgttgcaatcaactgcagatccggtgcatgctccttcagccactcaaattctgctttttcttccggactgatggaatccagatagatccgtattacccgaaagccatgagtaagcagaagctttgcaagtcccagtggacgcggatggtacagataatcaatggcaaccgcagtgtctccgatcacctcatgcgccttttccagtgccttttcacaggcagcaatttcctcttctaccgaaatcgtttcctccagctttccatagcccattgcctggcagaaattttccagctgtgctgtgatctcttcataatcaaagctgcccggcagatacaggtatggccgtttcagacgctctgaaagcgcttccgcaccatacttagatggtggataagaagatataaaaagtttcccttcggaaagtgccagatagtcttcccagcttttacatcccggcagctcccggaagattccctgatgtgcccggacgattcgtttcagatctgcatttttttccagtacgaaatcactgccgagaaaactcacggctttttcatctgcttttcgctttggaagtggttcataaatcgcttttctcagcttctgatccggtgtcggtccatgcttctgcatgatcggatccatataacagcggataaatgtaatctttggaaacctctcttccagttcctgatacacccgttccagatcgcatcccagaaaatgatgcagacagacggtaaataaaagaactgctttcggtttttcttccagcttattcagcacatccgtcacgccttcgatggtgatgtcctccagatttccatttaacagattctcttcttttacgatcacaaaggaaaaccggtcagccgcattcatttccgccgctgtcagcaccacacctcgcatgcagttatctgcacagacatagatctgtcttgcctccggcatcagcattccggtatgtacgatgttccagttgccgtggaccggcgagttaaattcaagccccggtgcaaatggaaccggaaatgtggcatccttgatggctactgccgcgcctttttcatccaccggatgtcctacccgttttaacatggtctctcctctccgcacactgcaaggatctgatctgccagtttccggtattcctctgccatctgagaatccgatgcatattccagcagaaccttgccggcttcttctgcttccatcacaagttcgctccggtcaagctgtccaatgatctgcgtgtgaaaatcccctgcaagctcccgcaccttttcttcctctctcggaacctctcttttatttaaaataataccgccaagggaagcatatccccggtttctgaaattctctactgccattgcaatattggccccggcatggatcgccatattttcaccggatgtgatgatgaatacctgatccgcatagccttttcgcattggcatggaaaagccaccgcagactacatcaccaagtacatcatataacacaatatccggctggtaggtctcataagcaccggtttcttccagcttctcaagggcggtgataatcccgcgtcctgcacatccaagtcccggtgtcggtccacctgcttctacacagaccacacctgcatagccaaccgtaaccatatcttccagttttagattctgtttcttctgttggaacatttccagtacggttggaatctcctttccgtgtcggagctggatggtcgaatccgccttcggatcacagccgatctgcatgaccttgtatcctttttcggcaagtgccaccgcaagattggatacagttgtggattttccgatcccgccttttccgtacactgctatctttttcattccgctttttcctccgctttcgtaatgacgttcgagtacgccgtttttgtggataccccattcagacgcccgatcttccctgacaaagcactgatcatatcttgcggtgcatcaatggcgatgctgatgatattaattcccttctcccggtacggaattcccattcttccaatgatatactctcctgcttcatgcaggtaatggttcagttcctcaatcgcggcaggattctccacaataattgaaatgactgctactctggtgtccatgaaaagtctcctttcttttttgaaatgtcaccgattccgcatttcagattgtttagcagatacgtggcagcaattctccgcccggctgtggaagaagtgcctgcgttccgatttctgtagtcatgactactttccccggctgctctgcagttacttctccgataattgccgcattctgtgaatacggacatttgtgcagtacttctacaatcttttctgcctctgcttttggtgccataatgaccattcttccttcacatgcaaggtaaagtggctccagtccaagcattccgcagactcccttcacttccggtgcaaccggaactttttcagcattcagacggattccaacattactttgtcccgcaatctcataaagtactgttccaactccacctcttgtcgcatcacggatgacatgcagatcatgtgttgcatttatcacttcttctacagtatgccatagtggtgcacagtcactggtcacatccgcttcgattccgaagtcttctcttgcaagaaggatcgtacaaccatggcgtcccacatctccggtcacaatgatcgcgtctcccggctgtgccagttctcctccgacttttacgccgtcctcgatctgtcccattccggttgttgtgataaatacaccgtctacctgtccctttcctgctaccttggtatctccggatacaatacggacaccggcttcttttgccgttttctccattgctgctgcaatctcttccagtttttccatcggaaatccttcttcaattacaaatgcacaagtcagataaagtggttttgctcccatacatgcaaggtcattaactgttccgcagatggaaagctttccgatatttcctcctgggaagaatgccggagatacaataaatccatccgtagatactgccatctttccgactggtggtgtaagaactgccgcatcatccgcagtcagatccggattggcaaaatgtgctgcaaatactttatcgatcaactctgaagtctgctttccgccggctccgtgtgccatagttactgtctggttgtccattttattttccatttttaacttccttctctcctaatcgtttccgtatatatgataccggattgttccggtgttccgttccttcgtttccctgataccggattgttccgcacttacgtgctctcacaatcctcaaaacattcgtaatccgctcatttttcttcgtaaaatggctacttactcatgttttggcggggataaaggtcagaagtcttcctgcaagcaagcttgcgtcggtgttccattccttcgtttccctgataccggattgttccgcactttcgtgctctcacaatcctcaaaacattcgtaatccgctcatttttcttcgcaaaatggctacttactcatgttttggcggggataaaggtcagaagtcttcctgcaagtaagcttgcgtcagacttctgacttttatcccctggtatcatacatatagtaagccgagcatgcgccctcgccggataccatgcaggctcctaccgggtgctgcggtgtacataccttgccaaacaccttgcagtcggacggtttgcattttccctgcagtacatctccgcagcggcatgccggatttgcttttccttcgatctttggcatattgtatttctttctggcatcgtatgcttcccattcttctctcagctgcataccggatcccggaatgattccaagacctctccactcgctgtcgcatccttccatcagttcattcaccagcctctgtgcctcacggcttccttctctggtgacaactctcggatagcagtttacgaagaacggctttccttcctggaagcgtaccagtgcgaccgcaagtgctgtgagcagttcttttgccgtaaatcctgctaccacaccgctgactccttcttttaccagttcctcacaaagttcagtccccgtgattgcattgacgtgtcccggatataaaaatacatccgcactgcctttgagtgcctcgtaggctcccggcatcgtcttattggcaaccagaagagaataattggaaattccatcttcctttgcctgtttaaccgaaaggcatcctgcaggtgtcgttgtctcaaacccaacggataaaaatgtcacctgttcttccggatgatctttcgcatatttttccgcatctgccggtgaataaacgatatggatctttgctcctttttctcttgctccggcaaggctcatctgacttcccggtacgcggaccagatcaccaaatgtacagatcgtcacctgcttctccaacgccagataaattgcttcatcaatgaagctgaccggtgttacgcagaccgggcatcccggtcctgagatcagttctacctgctttggcaaaagttttcggatccccagacggaaaatttcatgggtatgggttccgcatacttccatgatccgcactgccggtccgtcataattttctatgatctctctggctgttcgtttcttttgttcttccattacagcagttcctccataagctgatcggtctcgctttcatcttcatcggtgatctttgcgatcgcaactccggcgtggaccatgacgtaatcacctggttccagattctccaagagcttggatgaaacctctctttttgcaccgcctgcgtcaacgacggcggttccgttactgatttttacaacttttgctgataatccaacacacatgtgggtaattcctcctttttttgggaagggacgcaaggagagaaaacaattgggaccggctgcggtttcggagtccggtgttctctaggaaggcttcgtgttgctaagagcatttacagaaatccataactcgcttcgctcaaacagatggatttctgtaaataacgcaacactgcagtttccaagagaacgctcgggctcctgcaaatgcagccggtcccaattgttttctctccctgctggcgcttcctaaaatttaacgtgttgacaaagggggaattgacaaggcagtgccttgttgtcaattcctgatttgtttgttcctggtggtccttttcctcttttattgtaatttgtaatagtttttagattaactctgtttaaaatatttttatgtctggttttattttatctcatgcttctgtaaatatgccattgcgtaggctgcctgaccaagtgacaatcctccgtcatttggtggaatgaggtgatggtgcagggtgatgagaccttgcttaaccagaccttcttctaccagccgtagtagtaagcggttctggaaaactccgccgcttagggcaactttccggattccggtctgatgacttgctgtaagggctgcggatatgatctgtcttgcaagttcctggtggaactcgtatgcaagttttccggcatcttctccggcaagacgttttttggcgaggtttttggctaattcgccggtatttagaatcaggcggtcttctgccgtttctgtaaatggcttaagcatgaggggttcgtatggatgctgcattgttttttcgtaagcttctgctgcgaactctaatgccgtagatgcttctccctcgaaagtggattttttccggattccgaggatagcactgactccatcaaagagacggccggcactggtagatcgaacagcattcaggtgtcgtccggtcattgtcaccagtacttttgcctccggttcggtgcaaagctccagtttcttcatccattcgaccgttttttctttatcctgcaattcttcatagagaagagaaccggcaattcgccagccttcttttgcagaaagatctccacctacctgccagaatggcttaatgctgccaagtctttcaaatccattgtaatcacaacgaagaatttctccaccccagatggtcccatccgttccatagccggttccgtcaaaggaaacgccgatcaccggatcttcgcagtcattttctgccatacaggacagaatatgtgcaaaatggtgctgtatcttcagaaccggaagtccaagttcttccgcaacaactgtcgcattgtatttcggatgcagatcgcatgccacaacctttggttctacctccagaagtgtttccattctgccgattgtttcttttaaagcttccacggtgcgcagatcttccagatctcccacataaggggaggggtaaaatctgccgtccacaccgatacagaatgtatttttcagttctcctccagtggcaagtacctgccctttccacgacatctgaaccatggtcggaagtggcgcatagcctctggatctgcggatcatatatggctcatttttataaaaatccatcactgaatcatcggcacggatccggattttccggttgtgggaaagcatacagtcgcacagacgggaaagttcctgaatcgcttctttgtcctccctgcagatcggtgcaccggatgtatttccactggtcataaccaaaaaagacggcatccggattccatcatcataggtaaagagcagaagctgtaccggtgcatacggcaacattactccaacctttggattaccaggtgcaatactttcgcaaagtgtttcttcaccatcttcttttttgtccagaagcaggattggtttttgatgtccggtcagaattttttcctgttcttcactgatcaggcattctcttttcacagattccagatcttttgccataactgcaaatggtttcgccggacgttttttcagttctctgaggcgcttcaccgcctcttcattagtcgcatcgcagcacaggtggaaacctccaatccccttaatcgccacaattccgccttctgcaatggtccgtctggtgtaaatgatcgcatctcttccgcgttcttctctgccgatcaggcagacctccggaccacactcgttacaacagactggctgtgcatcgtatctccgggttaccggatcataatattcttttgcgcaatccggacacatcggaaattctttcatgctggtgcgctcccggtcatacggaagggcatccaggatcgtaagtcttggtccacagcaggtacagttgataaatggatgcagatatctacggttcttcggatcaaacatttcttccttgcattcatcacaaattgcaatatccggtgagacaaaaatctcacctttcgtcttttcactttcaatgatcgcaaactccgtaaagtcttctgcttcttctaccggctcaatattcattttcaaaattgctgcccgcttcggcggcttattctcaatatccgagataaatccatccactgcctcttccggtccctgcgcaaagatttccacatacggacctttattggacacgctgccccggatctgatgcgtagccgcatgcctgctcacagtcggacgaaatcctacgccttgcacgatcccatagacgcggatctgttttgtcacttcatttttcatctattcacacagtctccctgacactgcaaaatgtcttgtatttacgaagattccctgaaaatccggaaccattttttccatacatgcatctgcgaaaatgatatcaaatccaccatttttcacaagatcgatataatcatcttcctcacgcaacgacacatcctgcggacaggcaagctcttttttcctcataaaccaggttgctgtctgcacctctgccgaattctctcttttaagaatttcctgccggattgcttccgccatcacctgctggtgtaccacaaggattttctttccctgatagtccagattcggaaccaactcacctgctgccggataaccgatctcatacggcgtaccaaaggtcttttccaaatatttggctacttccagtgctgccgcagatacaacaatatttttgccaacttccgatgccctttctactgcctcaagcccatcgcccattccatagcaaatggcttcttttccttcttttttcagttcctctcttactttatctgctgctttcagatcgcttacatcctgtggcgtcattccaaggataccgactttttctttgcatacctcatatttttcctttgcaaatgcagtaaataatgcaagatacgctttttcttcccctttatcgtaaagctccattccgtcggtatcaatggcaagaatcggaaggtcggtctttttttcacacattcttttcagtgcctggtaatccgttccgatcacagccggaaccggagtgccgacaatcgccgcaaaattcgcatcaatcttatcagctgcatcgaccagctttgcgacaagacggtcatctcttccaaggattgcatccatatcacgaagtcctgcgctgaatactgcacttttccgttcaaaccatctcggctcatcaaaaccgcagacatttcctgtgcatcctcccgcgtcacagatgacgatgattccgccaagttcatataacacagacactgcgcccgactgatccggtgcaaatggtgtcagatattttctaagtcctctcatactacacctccaaaagggtttcaaacaaccgtgtcacacctgcataaccataaggctgtctgtcctgattccagatcacattcggctgatccggatgatagtatcccgcatcctttccaatggtcatattcacgccgctcttttccggatcgtagtacagcatggtcggttccatattggaaaataccttcgtctccgggctgagctgggataactggttcaggtaaataaagttctctgctgtcagtgttccatagatttccggcaccttaaatccatatttgatcatcgcaagtgccatttcaaatggatctccgttcatgcattccccgatcgcaaagcttgcatccggccgtttctctttgaatttcgccacggtttcttccgctttttcacgataaacttcatcagaaaatgtcaccccaagcactttcccaaatgcctgatactggctggcgatcttgtctgtctggtagagtctcctgagttcaataaacggaatctgcagacggttatgaaaatcctctgccgcaaatctggcttccgggtgaagtaccagattaaaatttgcctcagacatggtctgatattcctcatagtccttgcatctggagatttcatgaatggtcttaactcctgcgctgtgcaaaagatcatacagctcacactcatcgatcagcggcgagaaaaatccaagcaggtttaccacatttccttttttcttctttggctccagaagggaatataaagactgacgtacatgcaccatcggcggctttcttccttctcttgtcagcgcgtacatgtagcatggtcgaaccggaagtccgactctttcttccgcttttctgcacacacgctccatgtccgtcccaagaagagcatctacacaggtaatacagatcatcacaacggacggtctcttttcacagcaattgcagatttcttctactgccttcggaatctttttcaaatgacgtcccgttacgatatcggtctcgtccatcatcagatagaaaaaacggttatcatattccctcatggaactgataagcgaagtatttcgtccacagcagcccggtgccacgatcagcatgatcgaatccggcacagcaagtcccgctctttttactccgaatccttctgctcccggtgagttaaatgcaagcgttgccggtgaactgtagatcaggtgtgtattcgaccggagctgtaccggaatcgcatctcttcccagtttatttaattcttttacggtacaataatatgcttcttttgccataccttctattcctcactcttcagtaataactctgccagatcaaaaaatctcttactgatcgcggaatctttgtccccttcgatcaccgtcattccctgatcctcatagcggatgatctcatcacttctcgggatttccccgacgatcgggatcccgcttttttcggaaaatgcctgtactttttccgtctcattttccacattcctgtggttcagtacaataccgaatactctggcatagcttctgtcctcaaaattcctcaccgcacttgaaatattatttgctgcataaagtgccatcttttctccggaagttacgatcagaaccttttcggcgtacccttcccggatcggtgctgcaaagccaccgcataccacgtcaccaagaacgtcataaagtacaacatccggcttatatgtttcaaataactgcaaatcttctaacagctggaatgtggcaataatcccgcgccccgcgcatccaagtcccggtgtcggtccacctgtttcaatgcagagcacaccaccatagccttcttttgcaatatctgaaagctcctccggttcttcatcctcttctctcatataattcatcaccggtctgagcggctcgccgccaagcagattgatcgtagaatctgccttcggatcacatccaatctggattactttcttccccatcgccgcaaatgctgccgccaggttggacgtaatcgtagactttccaataccgccctttccataaattgcaacctttaacataatcctttttcctttctataaccaagcaggcaatttatcgtatacacaaaaaaacccgcctcccaaaacggtagacgagtcccactatacatcttcgtatatcaccaactgtttcccgctcggatctaccttgccgtcaaagtctctcgtataaaattatctccattcagcattcagataggaatcttccactccgtctgcatcattatttttaattatatctccacgcctataggtcagtcaattctaactatgttttatcatggtatttttctatattttttcagggcttttctatgaataactggtcaaattccccataaaatcttgtaacaaactttattgcagcgtatactacacctataaaatagaattttgaggagcccatatgataaaaaaattttcactacactgtatagaaaaagttttattcttcatcggcatttttctgcttaccagcgaaatcctgaaacaattactcctgaccttcgtcatgaataatgggcactacaacctgtggtacttcccattccagctctgcagcctcccgatgtatctgctggttctctacccattttttcacacagaacctgccagaaataccatccttggcttcctttccacctataatcttctcggtggaattgccgtttttttcgataccagtggaatgcattatccgcttctgatcctgacagttcactcctatctctggcatattttactaattgtcacaggaatcctgtccggtatatttctggtacagaaatctgtaccaatgactcctctttcctgttcaaaaaatattaaaagacagccgactgacgcttcttcacgccgtctgctgccttcttttccccgtatcactttgctttatattctgtttgtcctcattgccgaatacctgaaccacattctggatccctttggtgaaattaatcttttctacattaatccagattaccggatggaacagattttctttgtgaaaattggtgaactctacggaaataattctgcaattctggtctatatccttgcgactatatcaggggctgggattttgtatggagcctggaatctcatgatccgtttttattcttctcattgacattgcttttggaaaatttctgctcccttgctcacatactctgctcccaccttcaaactaaaacgcccggatcttatcctcctcatcatccgtcgtatcttcaatcttccgtatcacaagctcatacgaataatcatcgctaaccttcaccttcacagtctctcctgctttatgcccgaagattgcctttccgatcggagattcggtactgatataattatgaattgaattcccacgaatcgaagtaaccagcttataggtttcttcctcgtcatcctccggaaaatatacggtcacacggttattgattccggcaacaccttcttcggaagtatcggatacaatctccgcatttttcagcattctttccagataccggatccggctttcattctggttcttatatttttttgctgcatggtattcaaagttctcacttaaatctccctgcgcacgcgcttccttgaccgcttcaatggcttccttacggatcacatgcttgcgatgctggatttcctcttcaattttctttacatcactttctgtaagctgctcacgcatctttccacccttctttctgtaaaataatttccatcaaaatatgcatccactaatgcacctaacacaaagcacctcaattgtagccaatcgaagtgcttcgtcaaattttccaatatccctaaaagaagattctccggatatcattatacatcacaaataccatcaggcaaagaaaaagtgccattcctgccagatgtacatacccttctttttccggaggcacccgctttccgcggatcacttccacgatcagaaataccagacgacctccatccagtgccggaagcggaagtaaattcatcactccaaggttcgctgaaagcaggatcgtcatctgcagaagattcagaaaaatcaacagtgctccaccagatttgctttccttatacgtggtatccaccgcgctcacaatgcccaccggtccagataactgatccactccgatccgacctgtcacaagctgtttcaaactgtcaatcgtcagattgatccagtatttaacattatacgcactgtatgcggcagtctcaaatacattggtcttaacataattgctgctcgtaattccaatcagataatatccactgtcattcttctccggggtaacagaaaccgtatttttttcgccatttcttttgtatacaatcttcatcgtctgtccctgatgaaactgattgtaagtagaaatatccttgaaaatatggatgttcttatcattgatcttcacaatctcatcccctgcctgaagccctgcctcagctgcaggcgttcctgcatttaccgttcctatgaccggtttgtctacaccgacaaagcagataataatgaatgcaccaataaaggcaagaataaagttaaataccggacctgcggcaatgaccgagatcctgcgccacggcgatttgctgttgaagcttccctctgacagatcctctttctcatcttcccccatcacacacgcaccgccgatcggcagtattttcagacagtagtctgtatttccgatctttttgtgtgccagtgtcggccccattccgatccagaattcatacacattgattccattaatcctcgccagaagaaaatgtcccagttcatggaaaaatacgatgaatccaaaaagtaaaatcgccagtacgattcccatttgctacctcctgcttctgattctgtcatacgtttcctgctctgtgtccagaatctgttccacagtcggattcgcaattgtcttatgtgctttcatgcagtcttcgataatctctgtaatttccagatatttaatctcccggttcaggaactggctgactgcaagttcatttgctgcgttaaataccgttggaagtgttccaccgcatcgccctgcctcgtaagcaagtgcaagcccgtagaaggtatccatatccggcttttcaaaatcaaggtgtccgatactccagaaattcacacgttctcccggaagaaatcttctttccggataataaagtgcatactggatcggcagcttcatatccggagtaccaagctgtgcgatcactgctccatccacatactctaccatagaatggatcacactctgcggctgtacaaccacctgcacatcatcaatatccacattaaaaagccatctggcttccatcacttccagtcctttattgaccatggtcgaagaatcgatcgtaatcttacgtcccatcgcccagttcggatgctttaaagcatcttctacacggatattcagaagatcctcctgcttctttccacggaacgggccaccggatgccgtaagcaggatcttcttcagttcattctttccatggcttccctgcagagactggaaaatggcactgtgttcactgtctaccggaaggatcttcacaccacattcctttgcaagcggcataatgatatgccctgccgtaaccagtgtctctttatttgcaagggcaatatcctttccggctttgatcgctgcaattgtcggacggatgccgatcatacccacgatcgccgttacaaggatctcactttcctccatcgtggcaatctccagaagtccatccattccggaaacaacctttacatccagatcccggatccggcttttcagttcctttgccttctcttctgtccacattgccacaagttttggttggaattcccggatctgtttttccagaagatccacatttgttcctgccgcaagccctgtcacttcgatatctttgttctcacggatcacctcaagtgtctgggttccgatcgaacctgttgaacctaatattgctatttttttcatttgaatcctcctgtcagattacatcagtgcaactgccagataataaatcaccggagccgtgaagatcacactgtcgaaacggtccaggattccaccgtgtcccggaatcagttttccgtaatccttgatctcatgatttctcttgatcgcagatgctgcaagatccccgatcatggaaatgattccaccaacaaaacagatcagcgcatattcgacgactcctgccgaagcaccaccccatttattgattgcaagagcgtaaagcgcgccgagaagtgctgcgcctgcaagtccaccgattccgccctctatggatttctttggactgagcttcggtgccatcttatgctttccgatcagtacacccacacagtacgcacaggtatcacatccccaggaacataaaaatacaagtcccacgaggaaaagtccgtctttcaacagacgtgtctgataaatataggataacataatcgccacataaaatacgccaaagtacgcagtcattacctgttcagacacatatttcggaaaggcaaatacataaactgccattacaaggatcagcaaaatgattgcaaacatcatcagatcttcttttttctgtgcacggatcagaaaataatatgcaactacacctatatagcctacgattccgagtggtgctttctcaatctttacaaccttgtaaagctcggaaactccgatcagactgatgatcagaagtgttgcaaacaatacatccccaccaaggaagatcgttgcaaatgcaatgataaccagtacaattccgctgagtaatcttgtcttaaacattttcttcgtcctccttgattccgccgtatcttctgtctctgctattatattgctcaattgctttttctaattcttcttttgaaaaatccggccacggaacatctgtaaaataaaattctgtataagcaagctgccataacaaataattggaaagtctgagttctccgctggtacggatcagaagatccggatccggaatcccatgtgtatccagatatccttcaaacagttcttctgtaatctcctccggtgcaaatctgccatctgcacagtcttttgtcatttttcgcatggcacggatcatctcatctctgcttccataattgatcgcaatctggaaattcagtccgtcattattttttgatgcctcttccagttccttaattctggtacggatatcttcatccagacctgtcttatctccgatcacacggacacgcatccggttcttttccgccgtcttcagacaggttttcatatagttacgaagaagcttcatcagtgcatccacttcactcttcggtcgactccagttctctgtggaaaacgcatagaccgtcagatatttgacacccatcttataagcagcctcacagatcttttccacattcttgctgccctgcgcatgcccgtagtttctcggcattccctttgctttcgcccatcgtccgttgccgtcaaggataatggctatatgctgcggtacattcatcttttaatcctctcttgattgatactaaatttgctgatataaaaaaggaaaagaggcgccaaacatctcgccgccccttatctttccttcttatactgtcataacttcttttgactttgcatcgactgctgcatcaacttccttgatgtatttgtcagtcagcttctggatctgatcttcaagatcctgaatttcatcctctgaaacgtctgtgcctttcagcttcttgaatgcatcatttccatcacggcggatgttacggactgcaaccttggatgcttctccttttttcttaacatctttcaccagttcttttcttcgttcctctgtcagttccgggaataccagacggataacagtaccatcgtttgttggattgattccgatatcagacatcaggattgctttctcaatatctttgatgatcttcttttcccatggctggatctggatcatacgtgcttccggaacagaaatgttcgctacctgctggatcggtgtcggtgttccataatattctaccgttaatttgttcagaatattcgggtttgcacgtcctgcacggatagaagcaagctctgtatccagtgcatggatggttttctgcatcttttcatcgtatatttttaatttttcgttcatatgttatcctcccttaatgggtgctgcttatacagtcacctttgttccgttgaaattaccgctcattgtctctacgatactgttctcttcgttcagtccgaataccagcatcggcatcttattctcaaggcacatgatcgatgcggtcagatctactgccataagcttcttatcgatgatttcctgaatagaaatctcatcatacttcttcgcttccggattcaccttcggatcgctgtcatagattccgtcaattgcttttgcaagaagcattgcatctgcttcaatctcaattgcacggagaacagctcctgtatctgttgaaaaatacggatgtcctgtgccacctgcgaaaaagattacttttccttcgttcagtgcttccactgctgcatcttttgaaaacagggaagtgaatgctccacagacaaatggagtgaaaacctctgtcttcatgcctacatgtctgaaaatatcggatacatagatgcagttcatcaccgttgcaagcattcctatctggtcagctttggtacggtcgatcgtctcactggttcttcctctccagaaattaccgcctccggttacgattgcaacctggattccctgatctacgatctgctttacctgctttgcaacgccaatgcatgttgcctcatcaaaacctgtctttttgtctcctgcaagtgcttctccgcttaattttaaaagaactcttttcatctgtctttgctcctgtctcttggtttttaagatactttcgcatacctggatttagtatagcatacctgggtttaaaatggaagttctaagtttattacattgagggtgggtagcgcaatttcaacaattgattggaactatgcttctttattttctggctttcctggcaactgggcgaggatgatggcgctgaacatcagaatgcatcctgctatttctcggatacttagtttctgacctaatatcacccagcctccgaggacagagaatacggactccagactgaggatcagggatgccacggttggatcggcatctttttgtgccacgatctggagggtataggctacaccacttgagagaactccggcataaagtaccggtactgctgctgcgaaaatatctgacagccgtggtgtttcaaataaaaacattggaattgccgacaaaactccggttataaagaactgggtgcaggcgatccgcacactgtctgcttttggtgaaaaataatcgatcaccagaatgtggatggtaaatacaaccgcacatagcagtaccagaatgtctccttttgcaagtaccagcttatcggtaatacacagcaaatacaagcctgcgacagaaattgccacgcttatccagattctcactccggctttctttttcagaaaaattccaaagatcggcacaagcacgatataaagtgctgtaataaatccggcttttcccaccgttgtgtactgtattccgatctgctgcaggttacttgccacacaaagtgccagtccacaacagattccacccaggatgacattctttttttcttctttcctatctgcttttttctgtctttctgctccgtcatttttcgcacgccatttgtccagaaaacagatacatggaatcagaaaaatcccaccgatcaaagagcgtacacaggtaaatgtaaagggcccgatataatccatccccacgctctgtgctacaaaagctgttccccagataaatgcggtcaaaaagagcatcagtgtattttttcctgtcattttcttcatcgagccgtctcctatttgccaagttcgtgaagatataattttgcttctgtttcaatgaagatcgttccggctccgtttacactgaagaattcgatcagaagaacgtgacggattcttccgtccagaatatgtacacggttgacaccattttttgatgcctgaagaccatagccgatgatctcgtcaaattctttcgggaaattacgttctttgcgcagtttttctacttccgggacggtaatcttataataaatatcttttctctcttcgtctttgtaaattccaggatattttgacagataaaccagcttgtccgcctgcatcttctctgcaatctcaagtgcagtctctcttggatcaatatattcgctttcgttgtcgatatcatttggcacgatgaccggaatataatcattgtccagcatcagaccaatcgtctcggtatccacgccgcagataccgattgccttaactccacagagttcaagaagcttggcaatccgcttattttcacggaatttgtccagtcccatacgggtatcatgtaccacgatcggacgcataccaacgctctttaaaagaacgatatcctgcatcagtctctgctcttccactccactgagccactcggcacatccgtactcgataactactgtcttctgattaaagtctctgatatatggtaatgcatctatcaggattgaagctttatgctccacaagttctaattctttatccatgattacacctcattttttgttttatctaaaacagtatagcatagaatgatctctatttgaagaacccatttttcacaaaaaacaggaagtggcaaatgttctgtaaaatcaccctttttcgctgctaccaccatttttttcacatccattatacccggaagaaccggttccttgcatcagcaaagtaccggttcctctgtctcatttatttgattcgtgatataggcttccattccgctctccggaatcccaagtgctatggaaagctccgaatacaggttgccttctgccatcctcagataacgctcgtcagtcgccgtgatcttctttccctgcttcaggcgggacatcttccgctgataaagagtcttgatgatccgcacccattctgcacatttgcagcttttcatgcattccttgtacttttcctctctctgcttctcgcttccgatccagagtccttcgatctgtggaatctcacggatcaattcttctgcttcttctttggaaatgacttttctcatgacaatcttctcattgtctaccggtgtaaatacttttccatgcttttcacgtaccggtctcagaatataatacagtttgtccttcggcactccatccattttcagcgtcgtaatttcagtcacttcacaaattcctgtccggccataaacaatcaaatctcctacttcgtacattctcttccttctttcttaaacttgccgaatctctacttctttattttatcagaaaattagtttaaattctaatgtttttcagatttttgtggatcttagtcaaagctaacgcctgtggttttatgcaattttactagaaaatagggggattttgtcgcaagatgcgtcccaaaaagaatcctgccccattccattacacaatcatcggaatgggacaggattctttttgggacttagacactcgactaaaatttactctttttccacagtacgagaaattgataaaaccgggggaggggcgcttgaccgttgttccaggtggaaggtgtttcttgaagatacgctttattcatatgggcactctttcaataaacattcaaccgccatccggtattcccggatggtctggcttttgcggatttgcgtcagatattcttcgctgtttttaaagtttttgccaagataccaccagagttctttcattttgactactgcgtttttttcttctggagatttttcgatataggcatcaagaagatgatcgcagaatgtagcaatcttcttggtgtcaaatgtagatttcccttttataactgccggaaaaaatgggttcatcagaattcctcttccgagcatgatgcattctgcttcgggaaatttctcctggaaaattttgtagtcttccgctgaaaaaatgtctccattatagaccagaggatttttgctgttccggaagccgtaggcaaaagtggtccagtcgggtttgtttttgtagtaatcctgctggactcttgggtgaaagatcagttcttccagaggatattggttatagatatccagaagctcttcgaactcttcctgatcatatttaccgcttcttgttttgatagagattttcatatcgagttgattgaaaacttcggcaaggaaatgattcagttcatcgggataaaacaaaaaaccggatccccttttccggttgacgactgttttggaggggcagccaaggttcagattgacttcttcatatccgaattctttcaactgccgggccaggcggatgaaatcctcggcgtggttggtcaggatctgcggaacggtatacatgccctcattattttccggaaggatctcattccattcctgtctgctgaatttgcctttcgggtttggatttaaaaatggtgtaaaatatttatccattggttcaaaaaaggtgtgatacgccctgcggtatacctcacctgtaatgccctccattggcgccagatagattttcatgacctttctacctccgtcacataaagtgtttctttgtctacccggaaatgaatttccattcccgcgtaagacatgccgtaaatccggactggatccttttgataagaaggtctcggatcctgctccaggatctgaatcagtgctgctcttttttcagccggaatctgttccaaatacatttccgggaaattcacatccaatttataatctttcttttcttccgcgaaaccgccttttgcctccgggtggctatccacgtatggaaggtagggcttgatatcgtagatcggcgtcatatccagaagatccgcaccttccacgatcagcaccggaccttctttttcccggaattccacccccataagctttacggaagaaagtccgatcggattcgggcgaaatggagaacgggtggcaaaaactcccacccgtctgttaccaccaagccgcggtggacgtaccgtcgggctccaggtatcccggatagattccgaaaattcccagatcagccacagataatcatacgcctcgatttcccgcagtgcatccgcattctgatattccggcagaaaatggatttctgcccgggtatccgcaagattactctgtcgcggaatcccgaatttctccacaaaatcagatcttatatacgcgatctgctttatttgcattgttctttttctccatcaacaaacatcatcacaaaagcaaccgccagaattgcagaagcgatcagaagtgccttttcagcaaacatttccacacaggcatttccgataactgcaccgatcacaaagaagaagatgattccatagtacaaaagtcctttcttgatatactctttatccttcgtgttcgcataactgcacatatgctgggtcgcacttcgtaagtttccgatgcacatggtggttgcaattccgtttccatggattttgcggaagctttccacctgaatcccacatgcaagggacgtgagtgcattcgccaccagattaaaatcctgtgggataaagctgacactcagtaggatcactgcctcacagaataccgaaatctgcctccagtgcagaagtgtcaaatctttcgtccgtattttcaccagatccgcaagggcgattccaatggcaaatgccagcaccggaaccagatagtggagtgccatctgccagtttctctctgaaatattgattccaagaagcagaatatttccggtttgtgcattggcaaatacttttcctctgcacatataggaataggcatccataaatccaccggcaatcgcaaggatcacaccaagtttaattgattctgacatctgttttgaaaatttcaagttactcatcctctctgtcgtatgctttgatgtatacaaaattctcattgtttcgttctgtatgataatccaaattcagtgccgcgtcaagaaaatccttaccaccggactccactgccttcaccgtcatgccaagtgcctcttccacgtcctgcaccgtcagatcatccagaaagacctcttctccgcttcgcagcatattgatcggaatctgcagagtatctcccagatcctctcctgcttcttttctctcttttaactgtgccaccagatcctgtccggtaatcagaccggatacggtgatcgtctcaccaaagaaatcattacggatgcaggcaaccgtgatctttacttttggaaatgcttccgtgatcctgtctgcaaattcctgaattgtcggatacgcaagctttgcagtcgcaatggtaaatgtccgtgcgatcccttcttttaactttggatattcttcactttcctgaagttcttcaaaggcatggtaaaattcatctcgtaggagccgcatcatgccaacaccattttccagctggatatatccgtcataacgtccttcctctgggaaatcccgctctgcaaggatataccactcgtcacttgcatggataaaatgaagtccaaactcgtcatacgccttcttctgatagctctcgatcagatcaatgacctcttccgcttcttctttatcaaaaagctccagtggataaagtccctccctgtatttggaaagtcctgccggaaccactgacacactccgcataaacggcagatacttcatcagatcttcgatagaacgcttcagctcatccttatcattaactcccttgcacagtacgatctgcccattcatctccacatgtccggcatacagatcatccaggaatttcagtttttctccggcgaaacgattgtggagcatcttgcagcgcagctccgggttcgttgtctgcacagaaatattgatcggcgcaagctgcatctcgataatacggtccacatctttctgcttcatattcgtcagggtaatataattgccctgcaggaaagacagacgggaatcatcatctttaaaatacaaggtctcacgcattcccggcggcatctggtcgataaaacagaaaatacacttgttgctgcaagaacgatagtcgctcatcagaccattttcaaattctacgccaaggtcatcatcatactctttctcgatctccagaagccattcttccccgtccggcttgcggatcagcacttctacatactcatccttgatcatgtaacgataatcaaaaacgtcctctattttctggttgtttattcgtagaaggacatctcccggctcaatctccatcgcctcggcaattgaatccgggtaaacctcacggatcagatgtcgctgatactcatttttcttactcaaattatattcctcccaaaattcggaatcggaaacaagaccttttccaggctagcttcttctttcatgtaatcctcatatttttatcataaacgacttttcctgcaatggttacatactttttcatcataccataaaactgtaaatttcgatagggataaaattcagaagcctgaaacaaaaattcacccataaattcaaacgatacctttcattctccaaccaaacaccggggaacgaaaccttttacggttccattccccggtgtccggtttgtatatatggttatctatatacaatttccatatgcttcaaaataaaatattctatttctgataccgcatgttacaagaaaggcttgcggtcttttattagaaacggctaaatcaagttcctcctgttcttacgcgtataagtattgtcgacttctatatagtagcatatctgcggtgtactttcctagtggtaaaaagggagattcttttgctactgaaaataccggtttgacagcttgcgaaattcaccgaaatgtatcgaaaaatgttttctttctccgaattccttttaatttttcaaaatgaattttcttctttgtaatatctgtttaaaatcagaaacaggattttagtgattttttacagaaaatccgttcgattctacactgcatccccacgctctgtcaccagctcatatccaacacttgctactcgtctccccatacatccgcgacattctgctgcctcttcaccggtacagatcttgttgtcataaagctcatactgcttccggttcttcaccggagaaaggttcggcatcacaacattcgccccggcttgcagacctttttccctgccgagtggatccatcgtaccaagtgctgttgtcgccggaagaagtaccttcggcagcagaatccggatcacagcgagcaaaaacagtgtcatctccacacttcctgccggttcttttgcaaactgcgtatcgtggtgtgggataaacggtccgattcccaccatctccggctgcaattctttcaagaataccaggtcttctgccagatcttctgtcatctgataaggtgaaccaaccatcatgccagcccccacctgataaccaagcttcttcagatcatacagacaattcttacgaacggcaaggctcatcttctccggatgtagcttccggtaatgctcctcattcgccgtctcatgacgaagcaggtaacgatccgctccggcttcccggaaccttttataactctcataagacttctcaccaatcgacagcgtcagtgcacattccggatatgcctccttgatttttttaataatcgccaccatccggtcatccgtataataagcatcttctccgccctgtagcacaaacgtccggaatccaagctcatacccattctcacagcatgccatgatctcatcctctgtcagacggtagcgctttgcattcgtattactcttgcggattccgcagtaatagcagtcattcttacaataattggtatattcgatcagccctctggtaaatacctttttcccgtaataaatctcccggatacggactgcttcctctttcagtctccggactgcctccggatcttctgcacattttatcaattcgacaaaatccggtttcgtaaaatccggattttcgatgaatctttcgtaaactggtttcattctttccattctccctgcctggttttctgtatcttttctgaatttatgggcatttgtccatgaaattataaaatttattctatcacacttcgtcaaccgcggcaatcactccatcaatgtctacgatttcatcaagcggaatccggtctccactctgtaatacgatttcattcagataagtgtcaatcctccggatacatccggactttttctggtaggagccaccttcctttttctgatccggtacaaaatattcaaaatccacttcccgtggttcctgactctggcatacttcccgtaaatacagatccagtatctgtctgcaatcctcactgagtctgcgtttccgctcggtcagtctttcggtctccctgattgcatctttatgtccggtcagcgctgcaaacggggcaaactgcgccgctctgtcctgccttgacatctgcggatgtctgaccgatacatgatgcgctaaatgaatgatatcctcatatcctgtcatgccttatgtcctccgatctgctcattccgcgctttggtagtggctccttcctgaaaattaagtcccttcagaattgcattcttcccatacttcttcttaatcgaaagtactgcctcctgcatcttcttctcccgttcaaccttctcatcctgctgcttcttttcattgtctccggtaaaatcagtaaacagatccagttgccggaattctgtcttatctaccgctttcttttcatccaatacgtgattcgctgccatcgaaatccgccgcaccatcaaatgcggattcacaatccggtcatacagttccatcaccgcatcggttatcattctcgtagaagctgtatactctcgtagattcgctgttccatgtgcatgctttggaatctttcttccataccggtccactgtcacctcccctgtataaccttttccacttgtcagattctcgatatcatatccgacagtcagcacgatctgatccgtaaccagatgcttttctacaagatcaagtgtcaaaaggtccagcatctctttaaccacaattttcgccttttgggcatcatacgggcaatgtagtacctggcctgcgccaacactgttatgctccggctgatacgcttttacatctgcaatcgtacacggttcccacccccatgcatgatcgatcagaagttctgcattcacaccgaacattttatacaaaagctcttcgttataaaattcattctcttttccaaccgagcatctggcaatatctcccatggtatacagtccacattgttccagctttttcgcatagcctcttcccacacgccaaaaatccgtaagcggtctgtgattccacaaagatctgcgataactcatttcatccagacttgcaaaccggaaaccattctcatccggttcgctatgctttgccatgatatccatcgcaatcttcgccagatacagattcgtaccaattccagctgtcgccgtaatcctggtctgctcatagatttcccgcattatctttcctgcaagttcttccggtgtcagccggtaagtatgcagataatcggtaacatccataaaaacctcatcgattgaatagacatgtatgtcttccggtgcaacatacttcaggtaaatgtcataaatccgggtgctgtacttcatatagagtgccatcctcggaaccgccgtgatataatccagtgcaaagctctggtctgcctttaattccccggtatcacaggattgcccggtaaattcatgtcctccatttttccgctttcgctcgccgttgatctccttcaccttccggacaacctcaaaaagtcttgcccttcccggaatcccatatgcttttagcgcaggagaaacagcaagacagatcgtcttcgttgtcctctccggatcggctacaaccagattcgtcgtaagcggatccaaattccgttccttgcactccaccgaagcatagaaagatttcagatcaattgctacataactgcgtgtctgctccggcattcgctgcacctcctaacacttttcgcgggaacatatgttcttttttcaattatactatattttttcgccgaccacaagattacaactatagattttttattttttaggcagttggatattcagatccacatttccttcaatccccggcacacttcctgtactggaatactgccacatactgaacctatacggcgtctgcggaagttcttcataatctgcataccagatcggataatccaacagcttttccagatccagttcatacgcttcccacagcatattgctgtaaatcatggcatcatatcccgcttcttctatttctttacaaaataccttcgcattttgagtaaattgttctcccgttacaccatccgtccgtgcttcgtcttccagaatatgctctggatcgtacacaaccggcatctgaagctcctgccctttcaaatgttccagaacaaaatcagcctcttcctttgcctcttcttcatttaccgcctgcgagaaaaaataaacgcccacatctattccagcttttctggcattttccatattctgttcaaacttctcgtccgcatttaacgtaccttcttcaccatagccacgatatccgatccgcaaaattgcgaactcatagcctgctgctttcacctgctcccagtcaatatctccctgaaaaacagatacatctacgcccagccttgaagtatatttcttatcctcatagctgatcttattttcattttttacaaaaagtgctttatcatacggattcttcgcaactgcttcattgatttccaccgtataacactctccgtgtgcatctacaaaatcaagcgtatttttctcatctgtactttccgcattttttgcatccgcagaagtttctgctgttttctttccagaacatcctgcaagcaaagctactaacattccgaaaataatccatcttacttttttcatctattctccatttttcttcgttatattttccacagattctaaaatgtaaactgtgtattgctccacaaaaggttattatttatctcttttctcttcaaacctgcaagtgcaatttttttatttcaaaacatctcatgttattgtttatccgtagttgacggcatcggtcttttcggttttaagaagatttcaaaacatctcatgttattgtttatctaaatcagtatagcgtagaagaggacaatataatatttcaaaacatctcatgttattgtttatctgggagggaacaggcaacccggcgttcggtagctcatttcaaaacatctcatgttattgtttatcggggaattgtctggagatattcccggcgggttaattatttcaaaacatctcatgttattgtttatctcctgtggaagactttctggttatgacggtaatctatttcaaaacatctcatgttattgtttatcagcgccattgattatagtatctcctggaactacaaaatttcaaaacatctcatgttattgtttatcccaacgttctgatcctcgtctgctggttcaactattatttcaaaacatctcatgttattgtttatcagtattcgtatatttggtctgctgatggaatgatatttcaaaacatctcatgttattgtttatcttactctgtctgatggcagtacagaacatttctcatatttcaaaacatctcatgttattgtttatctcctgtggaagactttctggttatgacggtaatctatttcaaaacatctcatgttattgtttatctacagagaattcgtactcgccattcgtatccactgatttcaaaacatctcatgttattgtttatcggaaatatcccgtcttatgcataccagaatttctgatttcaaaacatctcatgttattgtttatctggtaaatgtggacgttacggaagtccttattatgtatttcaaaacatctcatgttattgtttatcttgaaagacgagcgtgatgaactgaaatatatgcatttcaaaacatctcatgttattgtttatcataattaaattaagttaagatatagaaaagcaaaaatttcaaaacatctcatgttattgtttatcatctttcaattctccttttccaagacaaatcaaaatttcaaaacatctcatgttattgtttatcattaactttccgcttgccttatatcctcattgtatatttcaaaacatcttatgttattgtttatcgcctctgcaaatgcatgggtgttaccaaacaaaacaatttcaaaacatcttatgttattgtttatctaaattccgcaaatcacgattccaataataccgaatttcaaaacatcttatgttattgtttatcctccattttcattacctctctgatatttttatttatttcaaaacatcttatgttattgtttatctgctgacctttgcctgtaacctttgtagttttatatttcaaaacatcttatgttattgtttatcaatcacagctctgatcgatgaaccgatcggactgatatttcaaaacatcttatgttattgtttatctatatcagcggtacagatagtgcctcattcgtaaatttcaaaacatcttatgttattgtttatcattctcgacagttgggcaaggtcttttagatttagcatttcaaaacatcttatgttattgtttatccctcgcatttccgcgttttttagtttctcccctcccctttttccccttatattttctatatttctccattttttaccagccaacacccttatcctggaccgccctacttatcatcccataaatctcttaatttttcaagctttcctggatttttcattctttttccgcctggtaaaaatcctataattatatcattaaactttctcctgttacctcccctccatttcccaaaacttcttctccaaacacattgtcattcatcaacttgataatgcaaataaaatcttcatccttgtctattacctggttcaaatccttccgcaattgtataaactttgatggcatcatctctcctctaaatacagacttttgaaaatgtgaaagatactttttacagatcttaaacactttctgaactcgtttttcattcacatcataaaacaaaaatgcataattataatttaattctttcttctttttcattacatcccttctttcaatgaaaatggaacaaattctttctcttccagtatatttttaatcagcttatagcaatccagcttcaatgccgtgcgatatgaaacttttcgttttaatttgggatgcataaatacactttccagacgttcttcaaatgactcaataaatatttttctgccttcctcatttaaaacacaatagtttacctgcttatcaaaatgtttttctacctgcaatctgcgattgtttaccaaatcaaatatcgttttaaatacaattaccggcttaaacacttcactgagatccaggcttaaagaaaatcttccttctgatggttcgtgaagaaaactgatcctttgatccagatgtgtctgataaattgcagcaattgtcttcgtatataacagtgtatttccaaaagaaatcagcgcattaattgggttatccggcggtcttttcactcgcttattcataacaaaatcttccggaagaaaatatacaaagtcgccataaaacctcatccatacttctccttcatatgccatcaactcttttacatcttcagcttgcactacctgtggaaaaaatgatttctttatccagtctattgtattttttacttcctttttcccatgtttatagtagtgataaaggacttcataaatatttactccaattccttttacaatcgcccttgctatatccattctgtcattctgatatttcactgcttgctttacaagtaattttccattcagataatgatcttttgggtaataagtcccactgtatccaccataataattgaaaaagtgaatgataatatgattctgtgacagaaagtccaacaactttgtgttaatacccacttcgttaaagcaataaatttcttttgtgttttccactggaatatatacattccttccatttttccgaaagcaaagcgaattatcctttctggtcagttctccaatggacatgatatatcttgtacttcccatttacatcctcccgattttaaatatagcagtattcataataagcacattttttgcatgtatttttatgaatacattctggcggtttctcttctgcgattagtgcttcaatctcctgaatataatcgaatagctgcttctccacttcatcagtaagttccagataaataatccttttatctttcttattcttctccacaaattctagctttcctttacgcagaattccttttttcttcaaaacacttaggtaatataaaagttgccattttgctgattccggatcagcatcggactttttcacttcaaccagatattcttttgtcagcttatccagacagatattttcaattgcaatttctgagttcgtactattttctgctctttcctcatgaatcgcttttccaatcttcacctgctcactgttatcttccagattcaaacgatttccatgcagatagcactgccttttgcagtgaaaatagtaattaatcaatgttccatttattctcacaggctcacctcatttcctaaataaacaagtccttcccctcttcaaacagctcgcgccttaaaatatcgttttcatcgaaatacgcttctccattttcaatataataaagctcaccaatctgttcatcctccataaattctgccttgcagctgaactgataaatgaatgcattcattttacttcgaacgttatgtagcttcactttgcgctcagaatattccatctctgtttcttcaatcagctgtttatattcatcccacacaaaccttccatcaagttcttctccattttcttcttggataatccttcccagataaacagatttcatcaatctgttatcattgattaactgcatccgcttatccaccttcggcatatcaagatttcctactgttttctggaaaaaatcttctatattttcatcattacatttctttttttccgccagtaccagcggaagaattccattttcataataggcaggaaagtttttcgcagtcaggagctccctcatttctttattcaccaatgttttatccttctcaattcttttgtccccactgtatattttctcagcattatccaaatcaaagaaatagacaatgcctgactttctccccgaccggttgattcttcccataaactgttcttcactgtccagtctggaaatatctttatagccgatatccatgtcaatatctacacccgcttcaactacctgcgttgcaaccagtataactgaatctaatgcttctattttccgaatcattctctttcgatccaaaatgctgctgtcacctgtcattaaaaataccggtatttcacttttttcacataagattcgataacattcttcggcacttctctttctgataaattcaatcaaaacttttttatttttcccagctttttttacaatctcatccgtcagatattccatcgtcattttctgttccaacagactgtaatccgccacaactcttctggcaaatttcggatgattaaaatatttctctctgttttcaatcagacgtattgtttggcaatgattatctgtcagtatatcgagattcggcaacgttgcagacataataataattttcatctgcataagttccgcaaaaccttttaaaaatgtaataatttcaccccataattcatttttataactctgtatctcatctaaaataatcaccgaatgactcaactggtgaaatccaaatacatcctccttcgcatgtccaaacattgttctgaaaagcatgacatgggttgacaaaacaatcggataattcaggaactgtctgtccagtaaaatccgattccagtcatttccttcgtctctgtctttcattgggacgagtgaatttacaactgctacctgtgacatcaccctttcattttcaccaaaaatctttccgatagattccatattttgctctaccagcgtattgaacggataaatataaaatattttatttaatttttcattttccctgataagccgaaatcccagattcatcgctgtattactttttccacttccagtcggagcttcaagataatagaatgtctgatctgaattttgcttcagaacccgttctgcatccagaaacatctccgttctcagaatattgatttcatcaattttttcaagtttttccttctccatcggatatgtctctttttcatattcacggattttcttctgcacatccccactttcatagatatcaatcatatcctcataatcgacgatctctccaaaatccagcatcctggcaccattcatgaattccgttgtcgcataataatcggctaccaccagaagagaatacaaaagcttcgttaatccgtataaatagactgttttctttacatcttctttctgcatccgcccaaacatctttttccagtctttccgcatcttagatatcccactctcatgcaaaatattctctttccacatcatataccaagattttgcccttttccccagattctctccttccatctgtttccctgtcagacttgccatatatgtttcaaattcttttaattctccatgatgtcgtgaaataatataagaataaatatatgcaaaatcttttaaaatttctgcctcggattttttaatcagctgctttgatccccacatttcattgattttcccaagaaaataatccaaataaaatacagatgatagaatcgaatgtctgctgccaatatttggatccggctttacctcttcgtgccacttatgatgcattttatcactctgaaaatttggattaatttttccaagatcgtgaacactgacaatatttactgtcataagttcaaatagatttcttgattctttacttagttcctccaggtaaacattctcaaactcctgaaaaatctcatcaatttttttccttttcacaatctctttccaatatttctgacagagttccgtatgttctcgcagtgtttcttttctttcgccattctctgaaagatgtgcgaaacatacttctccatactctgtaaattcagcaatcggcaacattaatttttcaatatccattttctattcctcttacaagaaaagccccgcaaactatgcagggccttctgttttagtaaaaaatcaatcttctgtttgcttctttatacacgatttcttccgttattgtcaccggcatatttgtgtaacaaaatttttcatactcatacaaattcgtataaccatttaaggcgattggaagattctcttcatatttgaaaacttccagatcatcctcatcgtctaacagacacagctctccctttcgttttgggaacattccggagatttcctgttcttgacaagttgtttcttccaattcaacaatctgcacattttttatgtctgcaggatgatcatttttcccaagatatggcatatatacacatcgtttctgtttcagactatctgcaagcttctctgccttatcacaatcaatcagcacataaatatcccatttcggattttcaagccactgttctttaacaatcagatttcctccctgctcccccgatgcataacctacggaattgttaaaaagctgtacctttttcggaatatatccccgttcattttgtggaatgattgaaatatgaagcttattcagtttctcataaaattccggatactctttgacaatactctgtcccttttttatctttgtccacttcttctgtgcatagccatcataacctaatattgcaccaaacattcctagaagcgcaactttatgaatctgcccaaatgtaaaatagtagtaagtatttacttccggttttttaaaaaaggcatttttgccactcagtgtaaattttacagccttcatacattacacctctttttgtgtaactatattataaatttttgcctcttcaattgcagacactaacttggtcgtatacgggttataatacacttcaacattttttattctatccttcatagcacttaagatttctgtgcagtcactgatatcaatcacatttatttcttcctcttttttgaaagtgatgtattctgataaatttggaagatataaatctggatctgtctctacaaaaatagcaaattcattttcacatccttctttcgcatttgttgcataagaagtagtcgctacaagcgctgttcttttgaaattttgataatcttcttctgtatagccttctgttacaccaagttttatccattccttgtatgtcatcggattgatcacgaatggataaaaatagtgtgcttcgttgcttgtaatttttgtgccaagggttgaattcttcgcttcttcctttttctcctcatcttttgcgtctctaaacggggaaagaatctgctgttcctctgcagttgtcccctcatatttgttaaatccctgtccaaactgaacggctcctgttattgatacattcactttcgccttcggttctgcaaaagtcgcgccaaaattcttcacatcgacagcagacaaaagattcgtcagtacttctttcccatccttggcatcttctaacttatccacatggaaaatatcttcataacgttctttgattgattttggaataagcgtattattttctccgaatttcatagatttaatgtaaaggaccttctttccttcatcatcccacatttttttcattggatacttcaatgctttatcacttccataaactgttccatcggacatacttttcggatagcccgtaaaatccgcattccagtttgccataatcgaagaaattcccaatacaccataaattcttttttccatactacgtttcctccatctcttttttcgaagattcataaaacagactgttgctcagataccctgcaataattggttcctgtcttattttcccttctaattcatatcccagaaccattccgtacatataattaaatcggctgcttcttgtcgcgatctcatgattgtacttcataaaatattgttttaatctggtttgcagcacctcattacttgttgcattaaaaaatggatttgcaagcgaatgtgtcttttcttttgctttactcagcgaaatataatatccgacaagctgccctactgcatagaaatattcctcatcgctttcaattatctgttctccccgacaattgatcttatctcttaatttctctctaatttcactgtatctgtctgccatattacatcctccaaaatactcatcaaacgaacacatcaaattaaactgctgtacaacttttcccatatatccatttttgatggattctttgatcacgttctttgctactgtatgaagaattctatccattccaacttctctgcctttatatagccatgcaaaaaccgcttcccttgaccatatcagaattcgcttcaattcaccatcgatgctcatttcgtcctctggtgtaaaataattacctgtcagccattttgaatagaacacttcatttacaatctcctgtaatccctgacgatttacatactctttgtatttgccttccctatcttctgcacctatcacatttcgatacaaaaatttctttttcagaaaatatttataatccacaatggtatcctgatgatgaatctccagttcttttcctttttgaatttttagaaaatatcccgaaaaatcaccctcgaccatctggtctctttttttacttataatcttcttttcatcataatcaaaaaagatatccgtctcacctgcatttgccttgttcatcaagtaatcaaaaaactttctctgcctgattgcctcttccggcgtaatcagatacggaatcgtcatttttcgtgtcttcttttcaagatatggcttcttggaattcaatcctaaattgtcatttgaaagtccataaatctgaccatcaatctctacattataatcatttttgttaaaaattttggtcattacatatctctgttcttcctgaacatataattttggttcttctgcgaaaaatatcttcagataatttttacggtttagctccaattcatctaatccaaaaatatgtcctttgatccattcacggtttttttccagctttttctggtctactcctccaatctactacaatatatttatggttaatatcccttacagccagtaaggaattatccatcttgttgcttaagctgtataatgatggagcaatcggtatatcgtcttccaatcttggacttcgcgtccgtaaattagactgataaccagctcctcattcgcagcgttcgttttatgcaggttgaatcgccataggtgcattcgcgtcacaccacagtagattgaataggcaatgagtaaaactggtatttatccattgcaataatcttaaggagtgaccatttatgaacgcagtaggtatcgatgtttcaaaaggtaagagtatggttgctatcatgcgacctttcggtgaaattgtttccgcacctttcgaaatcaaacacacagccagtgatatccattcacttgtagaactcatcaactctgttgaaggggagtcccgaatcgtgatggagcacacaggacgttattatgaagtcctcgcccatcagctttcaaaggcaaatcttttcgtcagtgccattaacccaaaacttatcaaagactttgataatgattctcttcgtaaagtgaaatctgataaagcggatgctgttaagattgcccgatatgctcttgacaaatggcaaaatcttaaacagtataatgttatggatgaattacgcaatcagctcaaaaccatgaaccgtcagttcggcttttacatgaagcacaagacggctatgaaaaataatcttatcggcatccttgaccaaacctatcctggtgttaatacttactttgacagtcctgcacgcagtgatggcagccagaaatgggttgattttgcatctacatactggcatgtggactgtgtccgtaaaatgtctctgaatgcctttatcgaccattatcaaaactggtgcaaacgtaagaagtacaacttcagccaatccaaagctgaggaaatctatggaaaagcaaaggaacttgttcctgtacttccaaaggatgccattacaaagcttataattaagcaggctgtggatcagcttaacagtgcctctacaactgttgagtcactacgcactctcatgaatgaaactgcatccaaactccctgaatatcctgtcgttatggctatgaaaggtgttggaacttcactcggatctcagttgatggctgagatcggagatgtttcccgtttcactcacaaaagtgctattactgcatttgccggtgtagatcccggtgttaatgaatctggaagttatgaacaaaaaagtgttccaacctcaaaacgaggttcctctgatcttagaaagactttatttcaggtaatggatgtcctaattaaaacacatcctcaagatgatcctgtttatcagttcttagacaagaaacgtgctcaaggcaagccttactatgtctatatgactgcaggtgccaacaagtttctaagaatctactacggacgagtgaaagaatatctttcatctcttcctaaatcttaattatccactaatattttcagaccagcactggtgtggtggtcttattttgataccaaattttcaacctgtataaaattttcaatgttcttcaatttagccttgactttttatttgcaggctttttggcaatataatcatacatcttccggtcttgtgattttttgtacttttctcttggatcttttaaaatatcaaaataccgatcaattgcttcttcattcaattttccattatcaaagctgtcccatttcacccagaacgccagataactgttagaatggattactttctttgtatcctgcggcttatccatactcaccaatctgctatgataatcataaaaacagattctttcatatagcttatcatccactgggattctctcaacagttctggttttcttatccatcctgactgaacactgtctgatctcaccgttcttttccaccacaagataatctccatctgccaaaatatattcatccaaaattaatctgtccgaatccccaaaacgctttttcgtccgttcaagctctgcttcaaatatctccaggcaatctttcagcatcttatcaccacctttttatagccatcgataattacaaaatcccattcctctggaattaatctctccgattcccacaccagttaaaaaatacgctagttcctgtgcctgcttattatctgtaattttcagattcagcttatcacccagcaacctgattcctttatattccactggtaccggttttcggttcaaaaaagtaatccctgtatacagttgaaactcttcatctatctcctcatttccaatgaactgtttatattttttgattgcattttcaaaaatccgccgttcatattcttccaccgaagcctggactttccagtacccctgctcccacttttgtatcactggtgtcagagtgtaaatttcactgatcatcttccttggaacaattctacgctccgcaataagtcctttcatttgattcgaagaatgattgcttaattcttttgcaaaatatctggcaagctctgcttctactgttcggatcgtgatcgtgtagatctgttctttcttataaattccatccctctccagcgggaataaaccattcatacaatataacttgtattgattcgtttcatggtaagttagccactcctgatctttagttagaacagaatctataaaatatgcttccgctgttagcattttggatagtggaatgtcttttagaagaaatacttttagtctgatttcaaatactgttatttgcttttgcaattttgcacctccttataatcattcagtatttatgttttatatagtttataaatgaccgatctgtttatttacataaaataaagcaaaaattcaaagaagatgcatccaaatgcaaaactccatatcaatatgcagaggcaattatcaatatctgctataattacgcctgcgaactaagtatatgtaatgtcacaaagcattatgatgtaaatgaattgtccgagaatttcagcggtgaaaagataacttttcgttctgactttttaaatcgtttaaaccaagactggcatgatgggaatcttgctgatgaaaaatatttattagatgaaacaatgtattttaaagaatttgaacagctgaaagctttacccaagttcaaaatagcggctcgctacacaggatacgtgtcatataaaacaacagcggaaaatgaaagcattatttatcgatatgaatacaatttcaacaagaaagttcaacaccataaaaaagaaattcatgcctcaataagaaaacacctgttacttgcaatcatatgtctgtttctggcttttgccattgatcgttgcttagatctgtttcaggatcagcttcagatatatatgacagcattttctgccacaaaggaactggctctactgccatgcataaaatggatccatattcctgccggtctaaaatcaatcgccggtcaggcactggaatggttgcttcttttgatcgtcagtgaagtggtcacctctggacttgcccatgtgtgtccagtactatcctctctgtcagatgcacttggagatataggcaacctaatcaaagatgctattgatatttcctttgccaaaccagctatttacaacaataactgcatggcagacattgcggccggtgaaaaaagaaataaatcggttcctatttcattagtcctttcacctgaactaaaaaaatacataaaataccaaaagaatgggactcatgcagatttatttaaaaattcttcgatctatccgattgcagatgtgaatgatgaatcaataacaaaaaatctgatgcagttagaagaattatatggctataaattcggagtcgtatatcagagtaatttcaatacactgattgtagatcctataaaaagcagtaattctgaagctccgaaaaagttctttccttacgaacgaattgtttcaccaaacggaaaaaacggggttgttatgataccgaaatacaaaaataactttttattgttaaatcagtatcgacacgcaccaagaaaaatgcagtatagttttccaagaggattttcagaggataatttaacttcatctgaaaatgcggcaagagagctaaaagaagaaatcggcgcaaccatcgtcaatgagccaattctgctcggaaacgtaatttctgacagcggacttacaggcaacagggttgatgtatatttggtagaaatcgaatcttttcagcaaaaccagctaattcacgaaggaattaaacagattatagaaattcctgtcaataaaatggatgattggattcgtcaggggaaaattgatgatggattttctttgagcgcatatgcattatatcaatcacatataaaataaagtatttaacgatagcacccggaaatcaacaatactttgcaactgacttctccgagtgctattttttcaaggcttacatatcatagaagaatcttatttacagactttttctcacagtctcttttgaactccaggagttcactttatttccgtcacaaactccactggcgggtaatactccagctctgttttcttcaaatactcctccagcatttccttcaatttttctataatgctaccatccttcccaactgagattcacatcctcagttacggcacatattaccgcacacttctgtacataacaacctaatttttgcggtttatcggacgccccatcttctccttcacttcatccagcacatcgatcagtccgaatcgatagaacattccgtatatgtaggtcactccccggatatcacccaaagctttcgggcagtctaccacttctcctttaatattcttcagcgccagcagcactgaactccacgccaagcttttactgttctcccggcggtcgatccacagctctttcgtgtgctcaccgttcctgccttttttaatttcgtaacagaatggcaacccggagtaggttttgaatttcacaccagcataggccagaaccacaccccagaagttttcttctgtcggatcagccctccatcgcttcattgttctgtatctccgctgccgctctgctccaacactgatttcctcttttgatgcagtacttgggaaatacacgcctttctgatatggtaggtacgaggtaacggaggctttggaaaatttcagggtgtttgcagttgagagtatggaggttttatagtcctgtgtttctcagtattcttcaaaagtgttttttactttttccgccacttctgattcatacacacctgccgtgatgagcagctttcttactttgatggggtttagagctagagcatcagcaatggattggagtgagcagtcttcctcataaagcaccactgcacttttcatctgctctttcagattcttcccggcatcatactccggcttcagcttcttcctgccaccgcctggttttcttgttttcttcattttactcatgcagctccagcggcagtccatccgggtcatggaagaaagtcatcttcttgccagtgtaatcatccacacggattggctcacattcaatcccgacctctgccagctcattcaccgtctgctccacgctgtctacgcagaacgcaagatgacgcagcccacaggcttccgggcggttcacacgcttcggcgggttttcttctgcaaaaatctccagctctgtgtgttcgttaacacgcagatctagcttccagtccttacgctctggacggtagttctctctgataacagagaatccgagcttgttcacatagaaatcctttgcagcttcatagttagatacaatgattgcaatatgatgtatttttgataaattcatttttctcgcgctccatttctttaaattttgttcttcttttatttccgttataaactatacaactaccttcaaaatataccatgtgaactcctggagttcagtttgtccacacggcatttattttttcttgggttattttatttcagcttttccagaatctcgtccgcactcatcccgctggtcagcagctgcttcagcactgcttcggcttcagccttcttagcttcttcagtagccttagcatctgcctttgccttcttcgcttcaagggatgctgcttctttttcggccttcttcagagcagtcttcttctctttcaagtcagccttcaaagtgtcaatgtttgcggtaatggatgcgatctcagcagtcaaagaaacgatagattcctgcttctctgcaatctgggatgcgtagtcgttattagttttgggacggtttttgctgcctttcgttctgggcattgtgataacctctttccttttatagttgtttaagtatagcactgtgttgggggagggcaatgttgctttctttaatcaactggtacgtcccactgaatctgattttttccttttccattcggtttgtttttccatgaagaaaacaaaacttatcaaagtcagagtattttgtttctgtatatggatactgcctatcatagcttcctatattagtaataaatcccgttcgcgcacaacgcaattcgtaatctctatatgtaagtgatgcacacaattgcttgtataaaccgaagttaaatgcatcatcaattttcatgtgcttaataagttctgaataatcacccttatagtccacaaaaagtgcaaggttaatttcacaccgagcaaatacctcatcgtaaactctttttgaataatacgccacaccatcatatccaagtcttttacatgccatcataatcgactgagaaattatgtattcagatttgaatgttctaccttcttcctttattctgtaagaagttgcaactgtaagcatgtataatttcagccagcaatgtactctattttcttcaaattcattcaatgcatggaaatctcttatagaaactgctagattaaaaaccttttgtgttccgtctaaaagaacaggcgatacattaaactcattttcagatggaaaacccgtttctatccagcacccatacgaagaattttccaaatataaacttggatttccaggaatactaaaacgataatttcctgactttgctcttaatttcaacggcaaatgcaacatgtcttttgccacataagcattagagggatttcccattcgacatctaaaaaactgaatttctgttcctgcaccgccgggaaacgcatagctcttccccaacgtgttaaccgcaaaaggatcttctcctacatccttaattagatttcttatgattgtgttgcacttctcgatgtccactttataatagcactttaatgcttccagtatcttatttctgaactttttaagtatcttaaggctttcatcatcagctcccgcagattctgcctactgaagcacaatcttatacttctttttcaaatcatcaatataatctaaatctttttccagaacaaacggtgcatacaagtctttacaaataaatccgttgttcatccatgtcaggctcatatgctattctcctcttatctcctcttaacgatggtgtgtttcctaatttctttccatcacatcttcgccgatcataatagatcgttgcctgctgctcaccacagagaggtgtgtgattatcagagcaacgtagggagctaccgcttccaatatatcacaagtctgcaaataaatcagccttgtatacgccatccgccaacattttcttgaaactgtcctttactgctgcaacgtcctcatggtaggtcattccgtaccaggtatcgttagtcctcagaaccttcacagacatttttccctgctccagcagctcaccgatgaaaataggaatcagatactctgctttcaaaagattgcccggaacttctttctcgaagaattctttgaatccctcctccagcacgttcaagaaatcaggggttaagccccacatattcatagaaaccagagaattcacatcgacaaccacgccatctacctctgctccatttgcggtcttgacgatgttcttagtttccacaacctccgtcaagtttccattctcgtccatcttgcagataccacgagtcacgccgccgttatcggacagtgtgttcttcagcacaaagccagccatgcaagactcaccaccatttacaagatactcatggacggcacggaaaccttccttgccatagtagtcatcggcattgatgacgatgaatggggttttgattgctttcttcgcaacaagcacggcttgaccggttccccacgtctttgtgcggcctgccggaagttctcccggaatatcgttaatatcctggaaagcgtagtccacagttacattatgagatgagcaaatagaagctatacgatcaccgataacctctttgaactctttcccgatatccttacggataataaataccacatgattaaagccagcctcaattgcatcatggattgagtagtccatgatgatatgattagaagcatccaccggctccaactgcttaattcccgttccgaagcggctaccgataccagcagccatgataagtaatgttgtgttcattttttcttttctttcgtctaaaattacaaaaccataaattattttttgttaccgagttcttccatgtattttttagcatcctccataaagctaactgcaatcatcacgattaccgcaccaatcgggaatgcagctacaatactcaccgactgaagattgttcatggagctttctgcaaacagcaaagcaatcggaagcaaaatcagcagaatgcaccacatcaactgaatgcccttattcggttgctcgccgtcctccagtgtatgatagctatagcaagatgctgtcagtgcaatggaatcaaaggaagtcgcatagaaagcaatcatcgtcagcaacacaactaccataatgacaggtgcacctggcatcgttttgatgatagacacaatcatgccatacagatctccgctttccagatactgtgcaataaagtcagcctttccagcgacctgcattcccatagaataattaccaagtacgataaaactcgtcaacgtagaaccaacaccaaatacataaccgccaaggattgtctgacgcactgttctgccacgagaaatgctgccgataaagaacggggcggccacacaccaaaccatccagtaagcccaatagtaaatcgtccagttctgcgggaaatttgatgtacggagcggatcagtaaatgtggacaaatcaacgaaattctgtaccatccggccaagagaagaaaaaccagtttcaataatataccgtgtttctccaccaaacagcagtacaaaagcaatcaggccaaagaacatataaatacaaatatttgccagcttgctaattcccttaaatccatgcaacaaggaatatgtatatacagcgcaggtaatcagaagaataataatgttgatcacagtacgactaacggcaacatggaacagctcactgataatggttgccatcagcggtgttgctacactaaaagtggtagcagtaccagcaaggagtgcaaatacagctaacaggtcaataatgcgacctgcccatccatctgtatgctttccaagaatcggacggcaagcctctgaatatttctgacgatttctttttctcacatgaagcataaaaccaaaggcaacagccagtaccagataaaatccccaaggaataaagctccaatggaacagcggatatacacctgcccaatcctgaatacttcccatttctgccagatgtggatcagtcgcatacagcacccattccgagaatgaatagaacaggatatccgctgccagaccacaggtgaacatcatggagccccatgcaaagaaggaatacttcggcttctcattctgctcaccaaggacaatgttaccgtacttagaacccgctatatatatagaaaggataaaaattcccaatccaattactaagtaataggtaccaaatgtatcaccaaagaaaaaacggatctggctcagcaccgcattcgattgctccggtgcaaaaaagaatagaacacataatgcaactacgattgccaaaggcaccagtgttatcatccagtctattttcccatgttcttttttcgtattcatttacttatcctccacatattttttgtaactggcatccagagcaattagttcgctcagattatctacctctataatatcgtccttattcataggacggatacccaattgatactcctccggataacagaacatcgccacatcatcccagtagatctgtcggttctttttttgttcaaactcaatttcgagatgttctttcagttttttcccatcctctgcagtccagcgggaaatactgtacagctgccatcctccttttccccctgtccggctgcaggctgtgacaatgccattttcgacagtctgaagccattcatccgtttcagcatctgtccaaacactgttataaccagagcgtttaaattccggtgctagaatttccggattataaataatctggtcaccatccagaataatcgcattttcaatatgatctcgtgccacataaagtgaagagatattgttgcaagtattatagtatggattttcaatcagtttgacaccaggatactccttttcaagtatcacaaactgttctttcagataaccgacaacaacataaatttcacagattccgtttttatgcagaccatcaatgactgtgtcaatcatccgaaccccattcactttgaccagtggtttcggtgttgtcagcgtcaccgggtgcattcgatttcctaaacctgccgccataataatggctctttctactcttggcatttacttttcctccctttgttttttcagttcttcttgaacaattcgataatagtcttttgcgtatcggtactgccgaagagaatactcaccaaactctacaccgagatttctcttatactcacaccagttactccacaacagaccacaagcagcaatgtagcaataaatcttaatcctagtttcatcactgcagctttccgtaaaataggctgcaattaggcgatcgacctgacgtttattgtaaagcgaataaatacagaacatcgccacatctacatgaggatcttgcattcctgcatactcccagtcaatcagtcggatttcttccctgccatctttttccacaaaaaggaaattatccggcactgcatcaatatgggtcaaaactttttctccagcatgtgcattaatataagacttcagtgacagaacatttgcttttgttttttcataatccttataaacagaaggcatcccctcccatagtgtttcatagaactccatctgtccgaaaatatcaaactcatggttaactttcaatttcaagtcatggaacgcatgcagccgcttcatacacttcttaacatcttcgtagttcaacgggtcgcatactcttgcgccttccaaaaattccgtgattttatagccattttcagggttgatatatgcaatatcatcgcaaatatgctttccatcaatagcctgataaactgccgcctcctgacgacgattaataagttggtcagtcccctctcccggaatacgcataatatatttctttcctttgcaagtaaacaggaaggaccgatttgtcataccttttttcaaaacagtaatatctgtaactgcttctggccttgcatccagagtctcacaaatcacctgaattgcatctgttttcaactggttagaatcgctgtcaatttcccggagttgctcataagtattgatttccactacgtccgctgaatgaaccacacgagctgctactatcatccgatccttattataaagggcctcctcccagaatgctccatcgtacctctgatttttgcatagttcttcaatacgttttgcaactatgtcggcatcctcttttaccaagtaacagatacctatcattgcattaccgccagaactttctggtacagttaccaattccattttacgattaactcgaaccgtactgtcgttgtctacaagatcgctgaccatataccaggaatacagttcatgtcgatggaatggatttctgtcgcaccaaatatcacaaggaataatgtaagcattttccagatgttcttttataagtttgaccgaatgcaaattattctttgacgcataatcggcattaactacgagttctacaccatactcatcaatcaaatactcgtatttttctttcatgaaacctacaaccacatagatttctttaatccccacttcatgaagctgcttaatgatacgttcaatcaatgcctccccattgacttccaagagacctttcggcatttctgtattaatgggaaccatccgcataccgaatcccgctgccagaataacagctcgttgcggggttttctgcttaaactcagttattgctttcgctgtagggcgaatcgaatcgtccagataatccgttttaatgagttcctttagcgaccgatttaccacccccaatgaatggcctgacacttccgccagaatcctctgattaataaaaggttctagcaaaagcgtgttcaggatatcgctttcttgtttgttcattattttccatttcctttctttcacgattttttattttttgtttttcgtgaacactttgtcaaacaaaaacctcctaatgacttgatttaagctttcaagcaaaaaggctgttaacaagctatttctcattttaaaagataaatcattaggagttcatattaaattactgtgtgtgctaggaattgactcaagtatatattagcattcacaaattactgataatcaccaaaattaattttatatttactgtgctcttttctgtcctcttcgggtggtaactccatatatgtcggtccatataatgtctttaaaaaattgtcactatcttcaaatccccaaaaccttttgttctcgaacacatatttttttttcctcaaaaacagtagattattcagatgatttttcggataatcactattaaaacaatactccgtgttcacagaattatatttcttaatatgtgcgtctcttaattgtttcaatttatcaatactaaatacacttccacctatcctcgacaaaatatatgagaactttttcttctgccaagatactccatatccacactttgtccaaagtaaatttttaaacaagtgatttatagccaagaatatatatcttctaattatattatctgggagattatcatacggaaaaatatcaacaaaaataccatgccttatattaacatcttttgaaaaatcctcaagtatctctgtcccttttagttgaaccttggcaaatgaaaagcagtaatatttttccgttctgccagtctgcaaaaaaaacttttgttgatctaattcactctcgcacaccttaataaatttctcataatctgcgcgtttcattgcaatatcaaaatcatcatcccatggaataaaaccgccatgtcttacggctcccaattgtgttccgccatccataaaatactcaatgccatttttttcacatattttttcaatttcctcagcgatatctagtataagtgattgaagtttcttcttctcattcatttttatattccccacgattaatatattcattttttgaataggcaatgtattcacctagattaaatttcacctatgtataatcttatttaaattttctaaaacgatgtcattcctcaatgcaataagtataagaccataaacagttactgataataaaaccgccacaattgagcatacataaatgttcaaaaaaacagtcattataattttacaacaaattataactcctatgcttccacagaaaactgaagtcaagttatttttaaaggacttattaaaaaccactctaccaattaaatctctacaacccatgaaattcataagcgccattataatttcagaaattaatgttgtaaatgcggcagctacagcaccaaagtatggaatcaagatagaattcaatacaatatttgtaaccgcactaatgattgagctttttagaaaaactttttctcttttatgcggtagaaggacacaattattaaagagtccactaaatgtcgaaaacaaaatagcaatgctcaaaacaatcagtggtaattgcgcatcaagatatttattacttgcaattattaaaatggcctctctacttaacattgtaagtccaacaattgacggcaaaatcaatattatcaatgcattcgccactttattcaacagttcttcgtaatcgtcttttactttcttcgaagccaaataagctagccgcggaatggttacagtcaaaattgaacccgttaagttttttacaattaaataaatttttgttgcaacactatagattccaacagcgtaatcgtctttcaaataccccaacattgtcgtatctgaatttacataaatctggattgcaatattggaggcaaagataatcattattggtttaaacagtttcttccaatctattttgagtgtaaatctaatactacatatttttttagcgttaaaaaaattcaaaacatttgatccaacagaagcaaaaacagttattgctgcatatgcaagataatcgccttcatttctcacaaacatgaaaagaagagcaactgatatcatcttaaacaaaatacttctgatcgttatgtatctatactcttcaaaaattgaatatacccactccgtgccaagtgttgtaaaaaatatttgaagtgaaaaaataagtatgcataccgtgtaccgttcaagtgtctttgaaaacaaaataaaaagaaaaagaagtgaataagaaacaagtgttgaaacaatattaaaactaaaaatctcgcttgcaaaagagctaaatctctccttattttctcgatactttgctccttctctaatcgcatacttatctattcccaatgcagcaagcagcaaaaaatatgaaattattgaatttgaaaaattatattttcctatttcttcaactgacagcactctcgaaatgtacggaaatgttattagcggaaataagaaattcaaaaatgtcttaaatccgtttagaaaggcatttacttttaaagatttatttttcatacttcacctgtctttctacaaatggtatcctatcaatattaaaatcatctaacatttcattcaaaaagagaatcacacactctaagtgctacctctatcgttacatccatatcgtaatacttatactcgccgaggcgaccgccgaaaattaccttgttctctgcatctgccagcttcttatactcagaataaagcaagccattcttggcatcgttgaccggataatatggctcatctcctggcttccactcactgctgtactcacggctgatgatagtcttcggcagatcattgccgttctcatctttaccgaactcaaaccatttgtgttcaataatacgggtccatggagtttcacggtcggtatagttcactgcggcattgccctggaagtttggcttatccaaagtttcagtttcaaagcggacagaacggtattccaacgtacccagcttataatcgaagtaagcatcaatcggtcccgtgtatacaaccttatcagccaatgcatccagctcagctttgttttccagataatcggtgttcaaacgtacctcaataccatccaacagattagcaatcatcttggtataaccaccaacaggaatgccctgataaagtgcattgaagtagttgttatcaaaagttagacgaactggaagacgcttaataatgaaagcaggcagttccttgcaatcacgcccccactgcttttcagtatagcccttaattagcttctcatagatgtctcggccgacaagagaaatggcctgttcttcaaggttctgtggttcaccagtgatttccttgcgctgctcttcgatttttgctgctgcctcctctggtgttacaacaccccacatcttgttaaatgtgtacatattgaacggaagagcgtacagctcacccttgtaattggctacaggtgagtttgtaaagcggttgaactcagcaaactgtgtaatgtagttccagacctttttgttgttagtatggaaaatatgtgcgccatacttatgaacattaatgccttcaacattctccgtataaatattacccgcaatattcgggcgcttgtctactaccaaaacagacttgccatgtgctttagcttcatgtgcaaaaacggctccgtaaagaccggagcctactactaaataatcatacataaacatcattcccttcttctcatgccatccagaattccccaaaaagcccaaaattcaaatgtggtcgtatagcttcttgaaacaaataggttaacacagtaacacagaaaaactatcgcaagtgccatattgcttttcctataatcgaagtgtattaaaaaccagataattttataaatcataaatacaataattaccgatccaagtactactccaaattgtagtatgagttctaaaaaaatattatgtgcgtagccgttagtggtaaaccaatatatcgcaccatttaattgagatctttcccctaaaaaaccatatccaaggggatttctctttattagctctaaagagacatctgttatagtggttctgccatttgcataggctatgctattcatattcagtccactcaacgcatcaataatacgcgattttattccgatagtactcgccaattctgtaaaaagagccagaattttgttataaaatgaaataaataaaatcccaaggacagctgcaaaaagcactattttatatcgtttagaaaaaatcaaaaaaaagagcaaaaaagctgctatgcacaaaatagatcctcgtgttcctcctaatatatttacaatagaacctatcataccaaatagaagcgtgactttattttttttaaagagtccatcatataatgcaaaaaggataaatactaaaatggcatagctaaatcccatatacgcagtgccaatttgtgatgttaaaacaataattgttgcataggaaataactaaatagctaattttcttaaatgcttcatatagggtatcgtaatttgcaatacatctatacaacaagaagccagacagccctgatataaaaacactgcggataaggttttccccttttataacctcaatggttgatttgtccattaaacaagtaaccaacatcatcaaaccaactaggccatatagcattaagacatccctgtgtataactctaaatgcctgtctaaaagaaattaaaaaaagaacaactaatacaaagtacattgcatactttaggatctgataaaccgttccttttccaaacattatagaatttagtgtaaggaaattaattctaaacataaacaaaacgacaaacaacgaatagacccattctattttcgttttatcaatttttattttcattctttttctccataacttcttgatataatgaataaacattctgagcattaatgactgctgtcatgttctctttagcataagtgcgtccacaattagcaatacttcgagcgatttctttattggttactgcccatttaattttattggttaagtcgttttcatttccatactcatatagtaaaccagttttattgttttgtattagttcctctgtcgctccacaagccgccccaataaccaaggtaccagaaagcattccttcaattgtaactcgtccaaaagcttctgcttttgaacacacacatgtaatatcagatttttcatagtactgttctgtatttccacaaaatccatgaaataccactttatcagtcaattctaattttttcactaatgcctgaagtttattagtatattcttcacttcctattccgacaatatgtagtgtaaaattctcaacatgactatcaaccaagcatctacacgcttttattatttggatttggccttttgattcgctgattgttcctgtaattaaaatatttacattttcagcatttaaaatcacatgcttctctctataaaatctaactgaatcgattccattatatattattgacagcttgtcctttggtaaaatattaacatatttattataaatactcttcgatatagcaataattttagacgaatcgctcatcagcctatatccatattttttgtcccaaatttcatcatgctgatcctcttctaaaaattctctaatatgccataccactggaatgttacattgatgtgcagaaactgcaccaatatatgtccagctcgtattaagatgcactatatctatgttatttctctttagccatatgtttaacttcttaattgcaatccagtttagtgcttcttttgcaagtttttgaacacgaaaagcaaaggtccttttttctccaatcgaaataacccaattataagcacgattgtaaaagaccggaataccattactcataagtaattctgatccattgccttttctttgaaccataacatatacattgcaatcataattatctcttaataatttagctaactgcaccatacttaaaaaagcaccagaactcttactattatcagaaggaatcaatagtacattcatatcaatcagcccctttcaccttttggatcatagcactttgggaatctcttcttaaacgacttgatagtcgaaataaatttatttttttcatgataatagattggaagtcttagaatcttatccgtattaacctcaacccaaacattcattagccgttctgccaaaaaacctaatgcccgttgctgatagggggtacgtttttgtaaatcaatattctcttcaacatagaataagatatcgaacagccattcacagtactcatcaaacattttcttcgatgtgcacatcatgttaaacatcggacttttattcccattcataatcctttcaaaagtattcagatattcaggatgtttatcagctattctttcttttgccagcgttaaatcttccccatagtgacgcgcaaaataaaaatcactcaaactcattttggtaagtgcaaattttcccgtaatgacatcatacgtttttagcatttttcccataccattttttgttataatatgagggaacacactttgaaccataaagaatcttcgataatgttcgatagagacatagtcagattcactatcatttttccatatccaataatacgccgtcaattcacaaaaatacttatttttatcagatatgttttctagtgtattatcacgtatatactcttttaatgattttcctgctccaacgaagattggagttcttccatcaggaacaaaatccacatctttatgcgttaccatatacattgttactttttccatacaaatacctctacccttagatctcaaaataataattttacttttgtatcactcacatatactcttattgattctttagcacctttgtcttgaaactatgcacagtcacattatttactcttcacatttttatcaaatccgtatatatcttatctagctgctttaccgactgagcgatatcatagttctgtattgcttccaaatgattttctctatatacaattcgttctttctctgatcgatattcaacggaaagtatggcctttgcccactgttttggggtatcgtcgatagatttccagataagatcattcaagtctacttctcttgtaatcttatccgatacaacacatggcaaaccagaaatttgtgcctccaacaatactactggaagtccctcatatctcgatggaaaaacaaatatatccatcgcagagtagagagctgtgggactatctgtttcaccatacaagataatacgatccctgtatggatgctcctttacacgagatttaatcttttcttcatccggtcccgttccaacaataaggagaatcgcatcgtctcgtatcgcagctacttctttaaatacatccaacaagtattcctgatttttctgttcgttgatgcgtccgatgtgtccaataatcagttgattttccatccccaactcattccttattacatctctattctttttagagaacacaaagtcgtccgtatgaaaaccgttcggtaaaacttcaaaattattctctccaaacaaccagtttcccgctaattgtccacaagccagtgcttttgtatataccgttctaaaatacggatttaacaatttatgcaccttcatgttagggcaagtactattatggctatgggcaattcgatttttaacacctgccagttttgcaatcgtcagttctattgccatcattgagctactaccgtgatcatgtacaatatcatagtgcccggctcttaatgctttccacagcgcaatataatgacccttggggtttccatgacgtgatggaagcgccactaaatggataccgttctccaagcattccttttcgtatttttctgaaattggttgtccagcaagaatagttaaatcatactttttcttgtccaacgctttacagtaattcatcattaccgttccaattccggtaattccaaaatgatttgtgaccattgccactttaatttttttattattcatttacattatcctcacagtcacaaatccattggaagtttagcgattacttacattgacatggtattttaattttctagccctcatagcaatcggaatggtcaccggacatatccacataatgactgctcttagtttattttgtttcgatgttggtacatgtaatgcactcaaagcatcttttcttgttgctttcaagcattttctgtacatttctgggtattctttttctaccccagcaagaacacacatatcgtaaaaatccgagtgtgttctccaatttgcatatttccaagccttgagaactcgatccgaacgaatcgtcagattctgttttattacctcaagtgcccataatccacattcacattttttaatcgaaaactttgtcatagcacttgttggattatctcggcgataataataggtttttcttcttcctgcaataaccttttccgctttctgaaaagccgccacattgaagttaaaaccttcgcctataaatatttcaggaataaatttaatgtcacctaaaaatttcgtcctgaacaatttacaatagcatccaatcggaacctgatagcatagaatcgcctctaccgcatcttcgccattccagattgtaatctcatcactctcgatttgttttcatcaaagtttccaaacatttgtgttgtcagggcgatatcagctttatttttaactaactgctccaacatatattcaatgtaatctggcatcacatagtcatcaccatcaacaaagcaaataaaaccgccacttgccatttctattcccgaatttcgagtggcactaacaccaccatttttcttatgaagtacctttactcgatcatccttttgttgcatctggtcgcatattaagccagagtcatctgttgagccatcattaactaaaatgatttctataaagtcccatgtttgcgacagaatagattccacacattttcccaagaaaggagccacattatatactggtacaataacagatactttataattttcttctgttaccaccccattttttgaggagtctaactgctccagccggaatcacggctttaagtcgttcctttggatggatgcccacctttaagttattcataaaatcatcctcatctattttctcataaaaggcatttctctcgtttggtcttaagctcggtttcacaagatttccttgcttcaccattccctcttcaagcgttgcctcttccacctctgcaagggggcgcattacctcaaagagtttttcccctttttcggtatttacaaatacactggacacgccttttggagaattaaaatccgggtggctcttggcaattccccagaaatcacccactgtcaaatctcccacacgactggtatttgcataggcacactgataacagctctctctatagcagtcgccatccataaaatgctttccatagcgatcaagggagagtgtctttgtctttgtctttgtctttgtctttagcaaatattgtgttccccaacctctcttatctttggagcggaagttgaagtagattactttgcccgcggtttgcttgttctggtattccagatattttttgaagaacttcggggaaggcacaccgtggcaaatcaggtcaatcgtatataaattctcatagtcaccgcccaagaaagcatataaaccagcaatctggcatggcgttcccgtaaagagtaccgtttttccctctgacaaacgctttttgatctttgtatagctgtctttcgggtcggactgaacatatttggaggattgtagtttttctctttctgcctcgtctgtcacttcaatgtggcttactgccaactgttcatcataagctgcgccatagactacaccgcccatttgcaaaacagtctttgccgcgctgtctgccgctccaccagatgcggaacgcataatatccgcatcatttttattgcgccacgcccagactttcttgggggtattccgatgaaactccgtgttctccaccggacattttttcaggcataatccacactcaacgcaacttttttcgtcaacggacggataccaaaatccttctttgttttctatcatagagatacagtgttttgggcagctttgttcacagcttttgcaacccacacatttctcttttatcctcgatatgttctccattctattcccctaaattttttccaagatactccttcgccacttttctgtgtgctttcaacagttcatcaacttttgcgtaatcgatcattttttcattgatgttttctgcatcttcaactttcgttgtcatccgattagccagtcccagtcgctttagcaaatcgctcaatttttcttcattaccatagctattgcctacactcttgcgaatcaatgtcgtaaacggccgatgtgtgatcactgagaaaatgctgccgtggaaggtatctgtaataacttcttctgcatttctgaaataggccagcacttcaaacggtgagcagtctacaaatcgatcggcgcatttctgaataccaccgattgcatataccttcaggttctttttctttgcataagcagcaatccagtctgcctcatcattggaaatacgacctgcatacgcatacagaatcaaatacttctcatcagaccgaagctgaggaattttatcacagcagttcatgtagtcataggtcagaaccgggtctaggttatacactggttctttccccgtaagcttctcaacaatggccccagaatttgcatctcgtacagaaattgcgtcaaaccttttcaacaaagttccgacttcagcagcctttttatacttttccagcttctccagcgttgtattaccgaaagaagctgcataagtaagaagtttctccgcacgattatcttttccaaacaattccggcgaataacccacattggaatttttctgaatacagttgaaaacctcatcactaccaatcacaaggcaatctagtatcgggttataattcatttcatccgtaattcctaaaagtggcatatacttttgggcgaaagactgtttataccggatgaacgataatttatgtgagaatggagcttgatactgaaatgtttccaaccctttcgctacttttcggacaaacttgtttttgctatccgcattttctgcaattaccggtgcatccacatgatagtccacaaactctacattgcagccaatttcctcgattagctgcttcagtgcatatgcctgcaaaaacgaaccgtagtttgcaatgcgctgcatcgacatgattccaacttttttcatccattcatcctcaatacaattcttttaccagtttctcaagttcttcattaaactttgcgttattgctgctcataccatgtcccatgccagcaacaatctgatcgtagttcgttataatgtctcccaatgtttcaatatcttctactgggataatcgttcccattctctgcgccacattccttgcaaactcaacctgatggtcatttacatgttcattgaactggtgctggcgcggcacaacaatgggagtttttccaatctgcagaggcataataaagcttgccggtccaccgtgagtgatcacaatgcgagcatcggccacattttttaccatctgctgatatggaattaacttgctccactggcaatacttcggttcatatgtactgaaacccgtctggataattacatcatcttgaattattccgtctttctttaattcatctaccttttgaatcagccgattaaacggctgctcatgtgttcctaccgtcacaaaaatcattttctcgtcccctacttagaatatgctgccaaggttaactgcctttggatatacctttttctgttcttcccactgaacaacaaacttgtccacaatggggtaaaccatctttcccgtcattgtcgatttatcaattcgatcaaaaacctcaatataaaccagctttgcccccatcatctttccaatgtagaagaatggaaccgcaacagctgcaccacaggaaataatcaaatcaggtttttctttgtgcaacacattccatgcaattttggtatttttgataagagctttaaggcttctattggtcggatagtaacacggatacattttttcgccttcgagtaggcttcttgcatcctccttatcaaaagtgacccaaaaatgatctttttccttccaaaatggctttaacatataaaggtgggttaaatgaccgccagatgaacccaccaagcatacttttatattttctttatttttcatctgactctctcctctaatcttccttggtcctgcttagtctctctggaaaatatctctcgtataaactttttctttcacatcatcaagatcttcactatacctgtttgcgatgatggcatggctcatttccttgaacttagccagatcattaaccactactgatccgaagaatgtcttgccatctttcagagtcggctcataaatcacaaccgttgcacccttggccttgatacgcttcatgacaccctgaatagaactctgacggaagttgtcgctgttgctcttcatcgtcagacgataaacaccaatcgttacctttttctccttgtcctcatcaaactcgttttctgcatcatagccgtagtaaccagccagctttaggacgcggtcagcgatgaaatctttacgagttctgttactctcgacaatagcctcgatcaggttctccggtacatctgcatagttagcaagcaactgcttggtatccttcggcaggcagtatccgccgtagccaaaggacggattgttgtagtgactgccaatacgagggtcaaggcataccccgtcgataatctgctgggtgttcagccccttgctctctgcataggtgtccagttcattgaaataagctacgcgcagggccagatatgtattggcgaacagcttaacagcctctgcctcagtaaagcccatgaacagagtgtcgatgttctccttgacagcgccttcctgcagcagaccagcaaactcgtgcgctgcttctaccaaccgctcgtcactcagatcagtgccgacgatgatacgagaaggataaagattgtcataaagagccttgctctctcttaaaaattccgggctgaagatgatgttcttgctattgaacttctcacgcacggatgcggtgtagcccacagggatcgtggacttgatgaccatgatggcgttcgggttatattccatgaccagcttgatcacagcctcgactgcagatgtgtcaaagtgctgggtgtggctatcgtagttggtaggggccgcaatgacaacaaaatcagcatcggcgtatgcggtcttagcgtccagcgttgcggtcaaattcagttctttctctgcgagatacttctcaatatagtcatcttgaattggagacttacggttgttgagcatctcaaccttctccggaacaatatcaactgcggtcacctgatggtgttgagaaagcaatgtggcaattgacaaacccacatagccagtgcccgcaacggcgattttgtaattcttcatgttatttactcctccggccctcatcaggcatatcctctaattttctatgtacacatccgtatggatggtatttctctctaattcctcgtgtgttcatcacacactcggctaagtgttttcttatgctgtcgtatccaattaccccagcaatcaatacttttctcgatattccgtctattttcctatatatcctcatccagacaggtttactcaataaaatcagttgcatctttttccgcatttctccggcgcatattcatacgccacactctgcaccctctacatcaaagtgttatcttattgagtagacctgtttttctacatctatttttccaaattttcccattccatctttttttgtaataatcatacaaacaaacccatcattcttattgcaccctgcacaatgatttattcattttttatgatgtctacacgacagaatattagtaatttccgtccgttactcaacgccacgcagataaatgcagttatcagtattaacaacctactgcacaaaacatgatttccgcagtaaaatgcggtgtatatttataacttatctacattatactttacatcaaagaataaaccacatgtttagcacttgtcatctattctttgacatctatttcttttcctacttcgatccaaccttccccagcacaactgccacagtcttaaacagaatcttaatatccaaccccggactccactttttaatatactcggtatccagtcttacaacctcttcaaagtctgtgatattacttcttccgctgacttgccacataccggtaagtcccggcttgaatgccagtctggagcgatgatgcatctcgtatttctcccactcgtccactgttggcggtctggttcctacaaggctcatatcacctttgagcacattccagaactgcgggaattcatccagagagtaatcacggataaagtttccgattcctttgataatacgcggatcgttatccatcttgaacatcataccatctttgatatcgttctgtgccatcagctctttcttccgctcttctgcatccatatacatgcttcggaatttgtaaatgttgaattttttgccattttttccgattcgcacctgtttgaagaagatcggtcccggtgacttaatataaatgattggtgctacaaagataaaaatgatacctgtcagtagcattccaaccagtcctccgcagatatccatcgtccttttgaagatcagctgaccggtgcttaccatattgatgctggtcgaaagcaccgtatatccttccagcttttccacaatctggttggaagaatcatccacaactcttgccagcttgatatgtacggtaattcccatgataccgaaatttccgatcagtttatccggaaacacaagctctgtcggaatgctgaaaagtgcttcatccacccagttcaactgtgcaaaatcttcaatcgcactctctccacaaaataccgggaatccatgataatttggaatttcattttcttttgcatcaataattccgatccccattacatgaaactcactgtagggattgccggtaaatgcctccacaatttctctataattcttttttccaccgatcagaaggatcgctcttttccctgatgcaggacctctgtgcttggaaagccattttttcaacaaaatccttcctatatataatacgcagatcgatatgatagggaatgcaaatgtgacaactcgtgagtaattgctcgactctttcattgcaaacaaatagacaatcacacacacggtcacgatgatcgcgtgctttgcgactgccttagcctccaaccagtaccctcttcttaagatgcccctgtaacttcccatcatcattcccacaaccagatcgatcgccgctatcgcaaaaaacacattccggtaaagcggtgcttctctgtaatatgcagtcccatgacgtaaccactgagcaagtaaataagatacttccaacaatattaaatctaacaaaataaaatcccagtgttttagccaactggaagttttctttctgtacataagtgaacccaaccctcttaaatcattacatttgtaatacgtctcttttaatatttataacacattttgcataaaaggtaaatggttactcacgcctaattacgttttaattgcttttttcgtcatttttacttttatcgcgaagaaaatccattacttttatctattttatttgacaaacccgcaactttttaatgcacaacaaaagcacccaaaaaggtacttttgttacttttctacctgtttttaggcgaaaaactaccaaccaccgaatattgatggttggtagaaaatccttgatttttatttcttcagtgcaataattgccttcaccacatcgtcaattcccatctcagagctgtcgatcagcgttgcatcttcagcctgcttaagcggtgcgatctctcttgtcatatcgcgctcgtctctttcctggatatcctgcctgatctgttcaaaatcacaggcttctccttttccttccagttctttgaaccggcgcattgcgcggcattctacacttgcagtcagatacactttaacgtccgcattcggaagtacattggttccgatatctcttccgtccataacgacatctttttcttttgcaagattcctctgcagatccagaagctttgcacggactgccggtactgccgagcttacggatgccatatttccaaccgcttcctcacgaagctgtgaagtgatgttttctccattcaaatagacttgctgcacaccattttcataaccaagctctacctttgcatcctcgcatgctgcctcgatcttctctacttctcccggtacgatcccttttttcagaaaatgtacggcaagtccgcggtacattgccccggtatctacatagatgaatcccagttcctttgcaaccagttttgcgatcgtgctctttccggcacctgccggtccgtcaattgcgatattatatcccattttatatcctccctgtttcactcacattttctgttcctgtccagatctgatggttccttttccggctttccgctgatattctcatcctcagcttttctcaccttccatccggatcatttcctgtttacgccatctctggattgctgtgcgatatctataatccaaaaactaccagatattacttcctgccgcatatgcagtcgaccatgcgatctgcagattgaatccaccggtcagtgcatccaaatccatcacttcccctgcaaaatacagtccctgtaccagctttgactccatcgtagacggattgacttctttgacttttacgccgccccgtgtaataattgcctctttgaaatctcgaagcccggtcaatgtcacagtaaaatgcttgatcagatggacgaaattcatcctctcttcttttgtgatcacattgaccttcttctccggatcaatgccgcttaagtgaatcatgaccggaagtaattttgccggaaacagtccggtgactgcatttttaaactgtttattatggttcgcatcaaattcccgcagtactctcgcatccagctgctcttcggaaagtgccggtttcagatcgatcacaagctttaactcatgctttttctgcagcattttacctacataggcactcgcactgatgatcagtggtccgcttactccaaaatgggtgaataacatttctccgaaatcactgtacagctctttctttccgtcatagaccgttgcctggacatttcggagggaaagccccatcaatgccggaatgtactcttctctgacattcatcggaaccagggaaggtgcaggtttggtgatcttgtgtcccatcgcttctgcaaagcgatagccatctccggtggaacctgttgtctgatagctgacaccaccggttgcgataatgcaggcatccccttcttctttgcttccatctgccatgacaagataggaaaatcttccatcctctgccacaactttttctacattggaataaagatggatgtgtactccatttcgcttcatttccagctccagtgtgcggataacatctgaagaatgatccgactgcggaaatacacggttgccacgctctgtcttcagacgcaatcctgcattttcaaagaaatccatcacatcctggttggtaaatccgtaaaaactgctgtacatgaatttctcattggataccatattctggaaaagttcatccacgtcacaggcattggtgacattgcatctgccttttcccgtgatgaaaagcttctttccaagtttttcatttttctcaaatacgtggacttcattgccatttttcgccgcaaagatcgatgcgaacataccggcagctccgccccctacgatcagtactttactcatttgatccttacctcatcttctacaggctccagctcatctctggaataaacctgatattcatcccagatgtcctccagtgtctccagcgtctcgatgacatcatcctgcttcttcatacagagtgcaaccaccagtgcattgatcacactgagcggtgcaaccagggaatctacgatagatgccatatcactcttggcgatcagattgcaggaggaatagagattcatcggtgaattcacactgtcggtcaaggttattacctttgctttccggttgctggcaaattccagtgcttttaaagtacgcatggaatatcgcggaaaactgatcccgatgatcacatcttcttccccgatccggatcagctgctcaaaaatctcgctggaactgttggtatcgacctctaccacatcctcacagatcagattcagatagaaagtcaggaattttgccagcggtgcacagcttcggattccgatcacataaaccttttttgccgcaaggatcgtatccaccgccagctcaaatgcatgattgtccacagattccaatgtctgcttgatcttctcgatatcagactgcagaaccgtcgccaggatctcgctccggtcgatccgtccgtaggtcacttccatacgctggatagaattcagcttggtacgcaccagttctcccagtgctttctggaattcgggatagcctttatatccaagctgtgttgcgaaacggacaaccgttgattcgctgacaccgactgcctctcccatctttgcagccgtcaggaaggctgctttatcataattttctttgatgtaatccgcaagccgcttctgtcctttgctgaacttcggatatctctcatcaattctaatcagtaactcattttttgtgctcacaatttgcctccaaataagaaacgtgcctttttataaaatcatttacttctattataaataaggtcacaaccctttttattataagcaaaagagccataaaattcaactcgaattttatggctcctgaggttacgttttgctcacaaaatactgtctgtaacagctttcgtcagttcggcgttattataccggataacttccgtcttttgcaattgtagcatctactttcttctcctgtgcctcgcggtatttgaagaagtctgtagctacctgcgggaagagtgcgtagctgagtacgtcttcatcctgctctttgtactgttccatctctttttcaagagttccgagttcatccgggatcaggtctgccggacggcatgtgataacttccggattgtctccgagtactttctgaacaacatccgggttgaacggtttaacagttgcaccgtattttccgctcaggatgtctttcgtctcttttgttgccatcttgtagcgttcgcccatcaggacattgaatactgcctgtgtaccaacgatctgtgatgacggagtaaccagcggtggttcaccaaggtctttacgaactctcggtacttcttcaagtacgtcgtagaacttgtcttctgctccctgctctttgagctgggaagtaaggttggaaagcattccacccggtacctggtacagaagagtcttgatgttaacaccaaggttcttcggattgagaagtccgctgtcaagtgcttcgtcacggatcggacggaagtaatcagcgatctcagccagaagattctggtcaaatcctgtatcataaggtgttcccttgaatgtctcaaccataacttctgttgccggctgagaagttccaagtgcgaacggtgaaatagcggtatcgatcacgtctacaccggcttcaactgcttttaagtatgtcattgaagcaacacctgatgtgtaatgtgtatgcaactggatcgggatatcaacagcttcttttaatgctccgacaagttctgttgccttgtacggaagaagaagacctgccatatctttgatacagatagaatttgcacccatatcttcgattctctttgcgatgtctacccagtaatccaaggtgtaagcatctccaagtgtgtaagaaagcgcgatctgtgcttctgctttctcagcgttagctgcttttactgctgtctgaaggtttctaaggtcattcagacagtcaaaaatacgaatgatatcgattccgtttgcaacagattttttaacgaagtattctactacatcatctgcgtatggacggtatccaaggatgttctgtccacggaagagcatctgaagtttggtgttcttgaatccgtcacggaatttacgaagtcttgaccatggatcttcatgcaggaaacgaagggatgcatcaaatgtagctccgccccagcactctacggaatgatatccgactttgtccattttatctacgatcggaagcatctgttctgtggtaagtcttgttgcgatcagggactgatgcgcatcacgcagaactgtttccgtaatcttaatcggtttcttttcaattgctgccattatatcttcctccaattattataaggtttattaagctccaggattgttatctcactgtcagatacgcgctgctcgcagcgctaaggaaacctgacggtttccttctgtgcctgatggcacagtctgacatttcgatagcaaccgcgatttgcccttgcaagcaagcaaatcgcttcctgttgctacattactccgaaaatagccataaatgttccggctgctacggctgttccgataactccggctacgttcggtcccattgcatgcatcagaaggaagttggtcggatctgcttccgctcctactttctgagatacacgggctgccataggtacggcagatactccggctgaaccaatcagcggatttaccttgccatgtgtggctacgcacatcagttttccaaacaggacacctgctgcggtaccgaatgcgaatgcgatcagaccaagtagtacgatcttaagtgtgctgacatttaagaatgcctctgcacttgtagtagcacctacagatgtaccaagcaggataactacgatgtacatcattgcgttggatgcggtctctgtcagctgtcttacaacaccggattctttgaacaggttaccaagcatcagcatacctaccagaggagctgttgtcggaagaatcatacatacaacgatggttacgatgatcgggaacagaattttctcaagctgtgtaaccggacgaagctgtcccattttgatctttctttccttctctgttgtgagaagcttcatgatcggcggctggatgatcggaaccagtgacatgtacgagtatgccgccacggcgatcggtcccatcagagccgtctgctggagcttacctgcaaggaagatggatgtcggtccgtctgctccaccgatgatggagatagcagctgctgccttatcagagaaaccaagagccatcgcgccaagataagctgcgaaaataccaaactgtgctgccgcaccgaggaggaagctcgccgggttggcaatgagcggtccgaagtcagtcatcgcaccgacacccatgaaaataagtgacgggagaatagaccactcatccagctggaagaagtaatacaaaagtccgcccgttccgttagccgaatcttctgcatgaagcatgatatccgggtaaatatttaccaggagcataccaaatgcaatcggtacaagcagaagcggttcaaacccatgcttgattgcaagataaaggaaaaaacatgcaactgcgatcataatgtagttaccccaagtcaggttgaggaacgcagtctgctgcacgaggtttcccagtgtgttagtgatatattccatgttataacctcctgtttttcaaaaggatgttgctccttagttcaatgtagccagtgtctgtcctgcttctactgcatcacctactgctacatcgatacttgcaactgttccgtcttccggagctacaacaggaatttccatcttcattgcttctacgataagaactgcatcaccgcgggatactttctgtcctacgcttgcttcgatcttaaatacttttccggctgcacctgcttctaccttgatgcttccagctccagctgctgcttttggagctgccttcggtgctgctttcggagctgcctttggtgctgctactggtgttgcagctgctccgtttccgttttcttctactgtaacatcatatacgttgccgttaactgtgattgtatagtttttcatctttaaatcctcctgattctattcgcactatgcattccatttgtttgattttcttctcttgatagaacgtactacaaatccgtctgtagtagttccttctgctgctgcgatcgctgctgcgataactgcaacaagttcggtatcatccatttcttctgcttcttctacagctgctgccactgccggagccggtgctgccttcggagcttcttcttttttcttcttggatgtaccgttaagtaatgcaggaacgtatttgatcagggaaatgataaagctcatgaaaataagcattacgaatacagttcccataccaagtaatgtgttaagtcccgctttttcaaggatttcgctcatgccgtaatgagcattgactgtaaatgattccagagtcatattctcatcgaatacgaattccaggtctgcacttctgtcagaaaatgttgccggtgcagttaccgtaacacctgtagaagacgcctcgaattcatagtctttatggctttcataatcgccgcattcttccagggatgctttccatccttccagtgcagttgcaaaagtgtctgcttccatctgcacaccggtctggctttcaaactgtgccatcagatatccctgattccagtctgacatctctgtgatctggtcgcttgtgatggatccgctctcaatgatatcaaaaacagcatcacaagactggatcagtgtatctttgtcatagctgacggtcttggcattcccgcagcctgcaaggccgagcacaagtaccagaactgcgactactaaactaatctttttcttcactttgcttcacctcgctaaattgttccgtgttttttggatggtctttcttccctttttgtaaataacatctcaaatgcaccgatcacatattttctggtatctgctggttcgatgatggtatctacatatcctcttccagctgcggaaagcgggcttgactgaagtgctttgtattcttctgtctttgcttttaatgtatctgcatctgcatctgtgtacatgatcttcgctgccatgtctgctgccatcattccgatctcagcttccggccatgcgtataccatgtctgctccgattgctttgctgttcattgtcacatatgcgcttccgaatgctttacctgtgatcacattgacttttggtacagttgcatctgcaaatgcataagtgagagctgccatctctcttgcaaggttcttttctgagcatgcagttgccttgagtccctttacatttgtaagtgtgagtaccggaattccgaatgcatcacagaatttaacgaaagctgctgctttcttgcatcccattgctgagagtgtgccgtcgaattcttctgctgtgttgccttcttcatcgtatacttttgagcggttggcaacagcacctactgtcattccgttcaggcggatgaatcctgttaccatatcttttgcataagctttctttgtctcaatgaatacaccattgtcagagatcatagaaagagcaagtgctgcatcttctgctgcattctcaagatctgcacatactctgttcagatcatctgtgcattcatcatatgcatcgttgtcttcgttgttagccggaagaattgctacgagtgagcggatctcgccaagaatttcttcttcgcttcctacgccgtcaacgattccggattcttcactctggaattttgcgcttgctgtatcgcatttgtccgcggtgttgcccggaatggtgttcggagagtttacgaataattttccgttctctgccatgaatgtaaaatcagaaagtgctgctgccgctgccagtccaccaccgcaattgccgaatactgctgtgatctgtggaattacaccagaagccatagcctgtttgtaatagaagcttccgaatgcgttcagtgcgtcagttgcttcctgaagacgaagtcctgcgcagtcaatcagaccgatcaccggtgcgcccatcttcattgccatatcataaatgttcgcaatcttctttgcgtgcatctcaccgatggttccgttcagtacagatgcgtcctggctgtatacatataccaggtttccatcgatcacaccgtaacctgtgatgacgccatctgtcggagcttttttctcctgcatgttgaaatctgttgctcttgcagttacctgtccaccgatttcaacaaagcttccctcatcgagcaaattggcaattcttaagctcgccgggtttgatgatgttgtgttgctcataaatctagccctccatttttataaatttaataattaaatcaaattttctgccgtgtatattatacttgctttctatgcaatacgcaactgtttttgataagttttctcttattttgttaaattttcgacaagtaattttcacgtgtaaaaaagcctctgcaacgcagaagccttttttttacataaacatattccctgttccaacataacggatgccgtcttcaaagactctttttccgccaagtgcaacaaattttacatcttttaatctggtgatatccctgcttaagtcaccgtcaactaccagaagatctgcatccagtccttcggcaacaagtccgcgttctttttccacacccagaacctttgccggattggaagttgccacctgtactgcctgcaccggtgtaattccgtattccaccatatattgcagttctctcggaagcggtaagagcggagaatgatacatcaccatatcggtgccggcaagaaccgtcacacccgtatcataaaattctttaaaatgatcccggtacgctttgtatgccggttcaaagaattcataattttccatctctttttgcatgaccggatcactgaccggtgcatcgccattcttctcgatattttccttgcacagttcatagagataagtatatgccatgatagtcggtgtccaggcaatacctttttctgccatctgctttgcatgatccagcgtcataaaggttccatgttcgatcgtgtcaaatccggcatcaatacacatctggatccccggattggttccggcatgcacgccacacttgattcctcttctgtggcactcatccaccgccacatccagttcttcctgggtaagctccggatacggttcgcggttggtggtcaggatcttcacccattccgcaccgtcgcgaacctgcttacggatttctttacggattgcccacggaccgtccgcttcctcgacttcatcccaggcatgtccgcccgtcatgcagattccggtatccgtatgcacgattctcgggatcacgataaatcccttcttttctgccagtttcagattcttgcatacaccatgtgctgaagacatatcccgcaccgtggtgatccctctttcaaatgcagcctgcgcatgctgcaacgcatataacatgatcagctgtgccccataattaaagctgtccggctgggaatagccgtatgcaagatgcgcatgcatatccataagtcccggaagaagtgtcgcatcaccatattccttaacttcctcctgcggaaattctttcagcagctcttcttttggtgcgatttttccgatcttgccgtcctctccaatatagactgccttatccgtaagaacggtctttccatctcctgtaatcagatatttcgtactgataatcatcccttggtccctcttttattcctttatttttcaaatacacgcagccctttcatgctgcccctctctcgtcgcattcattctttaatattttaaagtgcaaccattttgaagtgtattatacttgttttttcaaaccgacgcaaccgttttccatagaatctgttaaaatttttgcaattgtggaagcctctgctgacacaattttcgctttcagaggctcatcgcaatgttttgcacaatggacttcacccccatatttttctaaatctgccccactacctctccctcgcagaccgtccccacaaaaaaggaaacccttatccggcaaaccaccagataaggatttcctccattctttatacttttttaggatgacaacatttttattacaatgtgatcagagcatctgtaatatttgtaattctgcggtatccatcttctgtgatcaggaaatcatcttcctgacggacgccgccgattcccggaatgtaaattccaggttcgatcgtatgaaccattcccggctgaagggtcactttactgccggtacagatatacggctgttcatgaatatccagtccgaagttgtgtcccggaccatgtggaatatgatagcctgcatcttctactaccttcacgatgatatctctgagctcacccataaccattcccggtttcaggctgttctgaccagcatcctttgcttttctgactacgtcaaacatcttgtaaagctccggatttttggctttccctactgcaacagtacgggtaatatccgagcagtatccgtgataataagttccgaaatcaatcgtcacaaaatcaccaagctggatttttctatcggatgctgtcgcatgacagtttgctccgttatccggaccagatgctacgatcgtctcgaagcagaatccggagccgccacggcttctgaactgatattccagttcatttgcaatatcgatctctgtaacgcccggtttgatcacatcaagcagtgcatagaaagatctctctgaaatccggcatgcctgttcgatcgtctcgatttcttccggtgtcttgatcgcacgtaaaggctctacataagacccttcggaaacgaatttggtatcaggcgcctgacttaccagatcctgataatcatcaaacgtaagatctgctccacagattgcgcactgttttacccctgcttctgccgccaatttaccggtctggctgaagtaattcagtccttcaccgtagacaacaacttcaaatccttctgtttcctgtgcggcctggaattcaaaccgtccgtcggttacaaaatagtttttcttttctgtcagaagcaggactgcaactccatattctccggtaaagccggtcagatacttgatgtcgctgcctttgctgatcacaattccgtcatgaccatttttctttacagcatctacaattttctgtatgcgtgtattcattgttccatctcctactgaatgaaatcccagttgaatttcatatttttatcatatgatttgtatggttttccatcaatatcatagatgtttacattataatgccaaggttccggaagtgtcttctccggataaatgtgcttcatcagctcatatccttccggatcatagaccttcagttcctctcttgtgttgaccggtccgcggataccatcccatcgtccgtcaacaccttcctgcatgacattgaaccagacagtacttaaggttgcaaaatactcttcgtaattgctgatcgcataagtgtccggccacaaaccattgtcgctggcatgctgatatgctttccggatcatgtctgcaagcgtctggtctttcagaccattcattccaaccagatggatcgcatgtccgaattcatgcacaaggatcatctcatttggataactggttgcatatcttccggttctgagacggattacatttgcctctgaaatagaggatgccggattcgtcatctcaccgccgtaacctgccacgtggcgggttgcaagcagatatcccattctgtgctccgggacatcataagcattctcaagcagtccgaacacagatacctctgcacctctgcggacaagctcttctgctacttccgggatcttttcaagcatcatatcaataattgcaagtgctttatccactacagccggtgttgttttttctccggcttttactacaatgccggaggtcccttttttgcggactacataatatggctgatacacggtctggtagaccttttcattgtctaccggtctgtcttttacatcagtcagctttccgacaacctgtacggtaacctctcctgcacattccggatcaaccggatgaaccagggaaagtgtggtacgcatggattctttctggtataccgtaccataatcccatgtcatatcactggtccagtgtaccagttcctgtacttcccctttgtattttaccagataatcgttttcattatcagcacggcgcatctgttcgccccaataaatctcaattcttctgtcatcgatcagaatgactttttcgaccggtgcataattacaattctctgacatttatttttcatcctcctgaaacataaacttatttcctaatcttttatgcttctgcgttcttgtccagtcccattccgactgcaagctttttactgaagattgctacaaccgcaccgactgcacatacacccaaaccgattgctacgaagaacggaatttcacttccttctttgtagaagtttgtaagcagcgtgttaagagcagctcctgtagactgtgacattgaccagattgtcatcatctgtgtcatgaatgccttcggtgctgcaacagccgtgattgagtaaccgatcgggcaggtaaatccttcaccaagcatcaggattgcatagaataatacgatccaccatgcactgacttttgcatctccaggatagattacatagaggagtgcaatgattaaagctccaaatccccagaagattgttccgatacccatctttgtggttccgtatggctgtttctttccgagttttgtccatactgctgtcagaatacttccgatgataaccgcaaatactgctgggattgtctgcatagatgctgcaggcacttcaattccgaacagtacacggttaaccttttcttcatagaagattgcaaggattgaaattgtctgtgtccagatcagcagggtaactgcgttacagatgaacggcggaaccaggcagaggattttcttcttctcatgtggctctgtctttttacttttgtaaataactaccaggtatacgatcgggataatgatcgatacagtactgattacatttgagaatacagaaatacttaatgttcctgttgcaaaaagcgttgcaagaacaactgcgcagataacaagtacaatgatcatctttgtgatgaaagaacgtttcttatcatccggaagcggatcatccggttcaataccgatattaccgaagaacggtttgtatgtaactgcatatacaacgatacccaggaatgcaaggactgcacatgccgcgaatgctacatggtatccgagtgctgctgcgattgcaccggaaagtaccggagctgctgcaccaatgttggaaattacgtaagaaatcgtgtaagcgctgtcacgtcttccatcggattcatcatagaattttccaagaagagcatccagacatctgccaccgaacatcggtccgattgccagacatcccatagcgattccatagccaggaacgccaagtggtaatgcaaggcatacatatccaataaatgaaagtgatcttgctataaataaagacttccggcatcctaagatacggtcgcagacaaagcttccgacaatacctgtcagtacgacaactgttgaatataaagagatcagctgtgctgcatttgccttgctgaatccaagtccttccggtgcatttgcgtataagtagtaaatcagtaccgcactcatcgcatagtttgcaaaagagttacaaagctgcataaagcttagggttcccacaccctttggctgtcctaaaaaggcggtttgttttcttaacgcctcatcatgttcgttcattatttttccctccaaaataaccttttgtattcattcaacaaaaaacaatcgttaattatttccccatcctcagatgtcttcactcctccttttttcataatttttaacttttgttttttattttgaacatacaagtatcttacttttttttgttaactttgtcaatattttcgtctgtaaatatgaaattttgttcacattcataaacattgacaaaaaagaacgcaaaaaacgtcttttttccgttttttgcgcccttttttcgtcatttttatgtattatttatttctggttgcggaactgtaccggtgtgatattgtacgccttcttgaaaagtctgttgaaatgctctacattctgatatccaacggtcagtgcaatattttcaacggtcatgctgctgctctttaacagggcacgtgcctttttcattctgacttttttgacaatatccccaaaagtcattccggatttttctttgatatatttagaaagatacggtttagacaggaagaatttttctgccagatcatctaaagatacatccagataatttgcctggatatagttcatgatctctaccattctttcatctttacattcattcacattcttcagttcatcaatcttattgacagcaactgtcaatgcctcaatagaagctttgatgatatcggcatcaattccgactccccagtaggtctttccattgcagatgacacctacataagcacatgccttggaagaagaaccacgtgtcagggaatgttcttcgtagaagctcagttcatagctgataccaaagtactgtttgatcgcattgctgactgcgtcaagacgtccgttaccgcctgctgttaccacacgttttccatttgcatgggaaatggttgcatctgctataataccatcttcctgtttgaagtggcattcatcgatagagaagattcctttgtaatttacataatgatcttcaaaaatgtggtatacccagtccggagtcagctccttgtgtgctttatcggatacatcttttaccatgtagccgacttcttcacgcatttctttcggaacgctgatgccaaagttctgtttcagaatgtagcttacaccgccttttcctgactgactgttgatacggataacatctttatcgtaagttcttccgatgtccttcggatcgatcggcagatacggtacggtccagtgatctctttcttccgcttcacgccatgccataccttttgcgatggcatcctgatgggaaccggaaaatgcggtaaataccagatctcctgcatatggctgtctttcatagacatgcattctggtcaggcgttcgtagatttcacggatctttggaatgtcagtgaaatccagtcccggatctacaccctgcgagaacatattgagtgccagtgtcacgatatccacgttaccggtacgttctccatttccaaataaggttccttcgatacggtccgcacctgcaagaatacccatttcagcagttgccacgccgcatccacggtcgttgtgtgggtgaaggctgagcaccacgccatcacggtatttcagattcttatctacatattctacctgtcctgcaaatacatgcggcattgcgttttctacggttgtcggaatgttgatgattacttttttatcttttgtcggctgccatacatccagtactgcattgcagacatccactgcataatccacctctgttcctgaaaagctttccggactgtattcgaaagtaaagtttccttctgtctgatcagcaagctgtttcaacagctttgctccgtcgatggcgatttgttttacctgttctttgtcttttttgaaaacctgttctctctgtgcaacagaggttgagttgtacacgtggatcacagcatgtggtgctccctgtacagcttcgaaggtacgtttgatgatgtgctctcttgcctgtgtcagtacctggacagtcacgtcatccgggatcatgtctttctcgatcagggtacgcatgaactggtactctgtctcagatgctgccgggaatccgacttcgatctctttgaatcccacatcgaccaataactggaagaattccagcttttcatccagactcatcggctcgatcagtgcctggtttccatcacgcaggtcaacgctgcaccagatcggcggtgcgtctacataatcttttttcacccaatcatattcaaatttcggaggcataaaatattgtctctcgtattttttacagttttccattttgtttctctccttttatttaattggaaagggcggcatctgctttttcttctgttcatatgaaaaaacaagaaatttttcataaagatcacacaatttgcctaattcctgacttttcacaaatatccgtcaactttcttgtcttattttgttgtctagctaatgctaacatatcttatcgcgaaagtccattgatgaatttaagcaattttcttgatctattttatccttctcgtgttttaaaaattaaattgataaaacatttcacacattttcatggctatccaggtaaatgttctccgtctgactgtttcttttacaacagcctgacagctcccccatttctccccgtttaagagatacgtgatctgtccgaccggtgttccgcttttcaccggcgcatccagtttttccggtacttctgtcttttcttctgccacatcatcatctccgaccagaatcttacccggactttcttttcctttgatttccacttccactgctgtttttccaaacaaaccatttttggaaacactgttttccacgggtattttcgaaagttccggtattttccacacctcagcataacgataatgtgccattccgtactccatcagttttctggtatctgtccatttataattcttgttgtttggccagccacaggcaagcagtgtcactacaaatgtgcggccctcactctgcaaagcccctacatagcagtatccggcatccccggtaaaccctgttttcccggaaatcgcgccatccatcatctgaagaaatgcattgtggttgctgcagctaaaatttccctttccctcagcatcagaaaaactgtataccggcatttgcgtgatcgcaagaaattctgcagctttgggagaacgcaggacacagtagctcatgatttttgccagatctgcagctgaaatgctgtgcacaccgcccacatcctctccatccaatccgtttggcgtaacaaaatgtgcctcagtgcatccgatctcttctgccttttcattcatccacccggcaaattgcggaacggatcctgcaaggtgttccgcaatcgccactgcagaatcattatgggattccagcatcagggaatatagaagatcccccagataaaacgcttccccttcgtgcattcccagatgaaccttcggctgtgcggccgcatttgcagaggctgtcaccaggtccttcggatttcccttttccagcgcaagaatgcaggtcatgatcttcgttgtacttgccatcgggcgcattacatgttcttcttttccgagcaggaccctgccgctgtccgcatccaccagcgcagcggaacgggcatagagccgggtaagaagctgctccctttcctgctcacgggtttcttttttctgtgcagtctgcgcatccgagaccggttccttttgctgcgtagtctccattatctgtgtccgttcattttcttccgcaggcactttcccagataagaccttacccggactttctcctgtggattctctccatagcatctttccttgaaaaatctgcaaactaaaaaagaataccatgcacgctgccagaatccctcttctggtccgtgccggtattccattcctcttcttttctttctttttcatgcgccccggtctccctcctgctcttttctgttccattttatgaacagggacgggcgtttatactatggattctattttaaatattcagccggatctgtgcctcatcttccgcttcttctttgaatgtctccagcttctccggttcaatgcccgggagatcatctaaagactgcacactgaatctgcgcagaaattcttcggttgttccaaaaagcagcggacgtcccggtgcatcaaggcgcccaagctcgcagaccagattgtactcgatcagcttgtttaccgcatgatccgatttgactccgcgaatcttctcaatctccagcttggtgatcggctgacggtaagcaataattgaaagcgtctccagcatgacatctgtcaggacatactttttcggctgctttgcgatccggatcagatactcatacatctccggtttgctacagagctgatatgcatgatccaattcgatgatccggatgccacgctcctctttctgatacttgtccatcatattatggataagtttctccgtcgtcggcacatcctgctcgatcgcggatgcgatcttactcacctcgaccgaatctcccatagtgaacaggattgcctctatgatactctccaactgttttgttctcattttcttctatactccttgccgcagtccctcgtccgatgtaatgatgatatcatcaaacgtatgttcctgatatacctgtatctctcctgtcttcatcagctccagcaccgccaggaaggtgacaatgatctgtaccttggatgcctgctttttcaggagatcccggaaactgaatctgtgatgtacctttgcatactcataaacatattccagtttctccggaagcgtaacctcttctttctcgatcttgccgaacttacttcggatcggatccgtcttatctgcctgtcttttcaggatatcctgaaaaatatcattcagcttcgtcagggtcagcccgtcaagaagcgtatccagatctaccggttcttcgtattcctttacttcatccggaatggtcgctcccttatagaacagcttttctccgtccacctggcggtcacgcagttcataagacatgtatttgtacatcttgtactgcaaaagctgctctaccagttcctgacgcggatcttcttcctcgccctcttcattgacttcctttggaagaagcatcttgcatttgatgtccagaagtgtcgccgccatgaccagaaattcactcatgacattcaggtctgctctgtccatcgcctggatatattccatatactggttggtgatctctacgatcggaatatcgtagatgtctattttatttttatcgatcaaatgtaaaagcagatccagaggtccctcaaaaacctgcagctttaccggtattccttttcccatagatatcctttccagtcaaattgtcgataaccttatttattatacaggaaagccgggatgatatcaagtacgactaactctgccggattccagaagcggaaattgattgtgtgggttccaagccctttgctgaccacaatatatttcccgtctttttcataacagtccccgctgtagcgtggaaacagacggaactgcggactgatcacaccgccaagcagtggaagtctggcaatcccgccatgtaaatgtccggacagcaccaggtctgctccccacttccagtaggtttctgcgtaaagcggatgatgtgccattaaaatgcagtatgcgtccgtctctgcactgccaatccgttcttccatctcgccagtcgtaagcggacacaccttccatccttttttatagcatccaaatggaagctccatcccatataagcgcagcttcatcccgtttaccgggatctcttctgatccattcaccaggacatgaatccctgcctttttcagttcattctcataatatccatattctttgccgtaaatctccggctgctcatgcattctctgctcatgattgccattacagcaccagaccggtgcgatctgtggaagttttttcatcaaatccgctgccactgtccagtctcttccggctttcccgaccagcatatcgccgcctgccaggatcagatccggctttgcttccctgatcgccaaaagcagctcctcattctcttttccatagacatgattatgcagatcacttaagaaagcaatccgtacttttccggcatctccctttattttactggttctgatccggtatcttgtaatcttgaagcagtgcagctcccgccatacttctgcaagaactgctgttgcaaaaatcaccagtatcaatacaataatccctgttgccttcatctcttccctctttcgttataccatcatttcttccagaattttaaggaatgcgcccccaaatgtcaactccccgacaccttctgtcgcataaaccggaacgcttccgatggttttctcattcagccggtaaatgacttctccgatctggtcgcctttttttaccggggcagtctgtttctgtatctgtacctctttttccacggcagacagatctgatccactggtatccacataccggaagtcctccagcgtttctccctttgccttctcctgcattccatgtttcacttcggcatacacaattttttccagtgccttttcatcctggtaaatactgcatttcccaaagccatagtttaacatggcaatggcatcctttatccgtgtcttagaatccggctctgccatcacaaccgcaatcatattgaccccgtcttttcttgccgttgcagacaagcagaacttcgcaccgcttgtggatccggtcttcagtccagttgcgtattcatactgccggatcagtttgttggtattactcagtccgaattcactgctgccctttgccgtagtgtgggtaatattttccatccagatcgttgagtaatcctcgatctgtggatacttcgtgatcagttcccgtgacatcagtgcaatgtctctcgctgtcgtcagatgcccttccgtgtccagtccattacagttgacaaaatgggtattcgtcattccaagtcctgccgatctctgattcatcttttccacaaaagccggttcactcccggcaatcttttctgccatcgccacgcaggcatcattggcacttgccacagcaatgcacttgatcattgtatccacagtctgcttctcaccagcttccagaaatacctgggatccgcccatcgatgcagcgtactcagaagttgtgacttcggtatccggcgtgatcgttccgtctgccagtgcatcaaagatcagaagcagcgtcataacctttgtcacactcgccgggggccttttctcatccgcatttttttctaagagaacctgacctccggaagcttccataataactgcggactcagcagatagttccagaccggtcagattgcccgaattgtctctgttcgtctgctccggatcctcctgccggatcacatcctgcataactttcggtctttctcccggctcgaaaacatctgccgcccggaccgggatcccatatacggtctgcacgcacaaaaccatgccaagcagacctgccagaaatttgcgcatcataagactccttttttccatccatcgatactatataaataagccttctgacaggaaaatagaacctttctttacacttcccggttcattttttcgccttcctcattgaaccagtccattgcctgacagattccttcttctgcaaatgggaattctctctttgtgatcttttcctgtggaatcttatcataaataaacggtccttcccagatacttccgacaagaatcgtttctgaattttcctcatcggtctttttttcttctttcgccaggcgatagttcatttttcccatacttccgttaaatttcgcttttttataaaaattcagcggaaaaagctgcattctttctaacatatttttcacctcaaaaaccggcacagaaactgggggatttctgtgccggtactctattttttatacaattatatcaataagtcggaggaatgtctatactatgcagtcatctgatctgcctcatattttgcagcagcttcgttgattgcatctctcatgatctcgattgcctgatctacgtgttcttttgcaaggatcagtggcggaatcatacggtttacgctgtcgccgatcgctgtgatcagaagtcttcttctgaaacatgcccattttacttcaagagcgatcggaatatcgtattcacatcctaccagaagtccttttcctcttgcttcttttacatgtggaagctctgcaagtttttctttcatgtattcacccattacttttgcatttccacttaaatctctgtcgaggatttcagaaatggaagcaagagatgcggcacatgcaagtggatgtccaccgtatgtagagccatgtgttcctgatgtaaatactgcagctacttcttcgcttgcgcagcatgcaccgatcggcattccgcctcccatagcttttgccatcgttacacagtcaggttttacaccatatcccatgaatgccattggagatcctgtacgtccccatccagtctgtacttcatcgagaaggagaagcatacctctttcatcacagagtttacgaagtccttcgataaattcctgtgttgccggatgtacaccaccttcgccctgtaccggctcgatcatgatcgcgatcgtgttatctgttacttttgacttgaaatcttcaaggttgttatattctgcgtaggagaatcccggaagcatcggtttgaatccaagctggcatgcgttatccggctgtcctgttgcggaaagtgctccgtatgttcttccgtggaaaccattgattgctgttacgatatggtaatgttccgggccatatttttcaacgccgtattttcttgccatcttgatcatacattcgttggcttctgttcctgagttctggaagaaaatcttatccattccgatcgtgtcacagatcttctttgcgagaagtgcctgtggaattgtgtatgggtaattgaatgtatgcatgatgtcatcaagctggtcttttactgctgcgacaaccttcggatttctgttacctggtgtatttacggcaactccgccataaaagtcgaggtaagctaccaatgtcattaagttaaggaaaaataattagattcttatattagaaataatataggagtctttttattttgtaaaaatagttgacaaacaagatagaatgtgcggccgctttcgctaccgatatatattaaggttgcgaaagcggcccttgtaattaaggaatatcttgattgcaaggaggatacattatgagtcactatattgaaaaggttacggtttcactagaaaatctaatttcagaattggcaagaaatccatctttgttcttgaaaaatccagatactgatttttcaagaaaccgcaaaattaattttaagacatgtgttggcattaccatgaattccggcggttgcacgctgaataaagaactcttggattttttcgattttgatgtgaatgctcctactgtttcagcgtatacacagcagcgggctaaaattctaccagaagcatttgaatacttatttcatgcgtttacagaagaaaatgctcaaacaaaaaacttatatgagggatatcaacttttggcttgcgatggcagcaatctaactattgcaccgaatctaaacgacccggaaactctttggaaatcaaatcaacttggtgcaaccggtaatcacttacatctaaatgccctgtatgatgttttaaacagaacttatattgatgcattggttcaaactgcctctacgtatcaagaacacagagcatgcattcaaatgatagaaagggtgacattggacaaagttatattaattgctgatagaggatatgaaaactataacattatgtctcacgcaatagaaaaaggctggaaatttttgattagaataaaagatgttcacagcaatggcattgcatcaggcttagaacttccacaaacggcagtttttgatatggatatcaatctgattctgacacgaaatcaaactaagtcaaagaaacaagcaggatataaattcatgccaacagtacaaacctttgattatcttccaataggaagcaaagaggattatcctatctcctttagaattgcaaggtttaaaatagcagatgattcctatgaaacggtaattacaaacttggaccgtttttgcttttcggcagaaaaacttaaggaattatatcacttaagatggggcatagaaacatcatttcgtgaattgaaatatgctatagggctaactagttttcatgccaaaaaagtggattacataaagcaagaaatatttgcaagattgaccttatataattactgcgaattaattacaacatatgtagttgaacacacagaaaatataagtaagaaaaatcaggtgaactttactattgccatttacatttgcagagaatatctgcgacgcaaacggaaacttcgtccacctgatgtggttaaactgatagaaaaacatatattaccaataagacctgggcgtcgagaccctcggaaagtcaaacatcaggcgtcagtaagttttctatacagggtagcataaccattcatcattatataggattatagacagatgtacaatccatctgtctgtttgccgtgcaaaaaaacagataacaaaatgaaaaaagcaaaatacaagtgagattttacctacttgcattctgctttttttaatttttaaattaacttaatgacattgggtaagctacccctttttcatcgtagagatacataccttctgcacgttctgcgataaaatcatatcttgcataggtttctaccatatatttttttacaatgtcctttaattcttctgccgtgagtcctgtgtctttgagtttcataagaatctcctcgctttccttcttttgatcatatactacttcatgctattcgttccggacttcgaataaaaatgtgtaaaagaatgtgccttttgtttagcaggaaatcccttcggaatttaccgctaaacaaaaagacgccatgtactaactgtacatgacgtccttgtcgtttacaagacacagtatagaccacagtctatggttttgtcaacaacaattatgtcaaaaaattatctttcattttgtcttttgcttgttcaatctgctgtatttgttcctcatccgtgctttcctgaagattctctttcttctggcgataaattgtcgcagaaaaatccataatgtatccaatcaggatcagattgccaattgcacgccctgcacgaaccggtatcatggcaacaaacgctgcaactatgttctgcaggaacataaaaaggaacaacgtatagaatccccatgcgatcgaactctccagacagatgatccccctgtagttaaatggcttctcatggtaatcccaccagatctcaccgaaaatgcgcttcatcacaagtgccgtcagaaattccaacgtcgttgcaagaaacgatcccaggaaaaacagcagtatactattgtcgctatacggacgtaatataaaaaacaccgtaagagcaccaaacccgtagatcgggcaaaacggaccttttgcaaatcccctgttcgtaatcttatgattacaaaatgacatatagatggattccaccagccatcccatcatgctgtaagtcagaaaccacatcacaacctcatatccatctattccaaatattatcctattccaccacataaaattttcctgtaaaaatggagggtttatgaatcataaaccctccattattgttctgcacatattagttatatttacgttttctagcagcttcagatttctttttacgtctaacgcttggtttttcgtaatgttctcttttgcgaatctcctgctgaattcctgctttggcacagtttcttttgaatctgcgtaaagcactatctaacgtttcgttttctttaacgattacatttgacatagtctcacacctaacctcccctccagcctggtattgtgcatcatacgactgttcgggtatatttattgcactacattagattatatcatatttttcatctcagtcaagaattttttgaaaaataggaaaaatatgcataaatctgtcattttccggcattattttatctgttctgccagtacctctttgacttttgcaagggcatccgggattccagccgggttctttccgccagcctgtgccatgttcgggcgtccaccgccgccaccacctacacaggaagcgattgccttgatcaggttgcctgcgtgagcacccttcttcattgcttcatctgttgctgtagccatcaggtttaccttgccgttcgcgctggatgcgatcacgaccacgccttctccgatcttctccttgagctggtctccaaggtcacgcagtccgttcatgtccatatcttctacgctgacagcaatcacttttacgccggctgcttcttctacctgatccatcacatcacccatggcatctttcgcaagcttgctcttcaggctttctacttcactgtgaagttctttgttctcagcctgaaggtgtgcgatcttctcagacacagtatccggagttgctttcaggagcttggctgcttcatgaagcaactgttccagttctccataataatccatcagtcctttggatgtaagtgcttcgatacggcgtacccctgctgccacaccactttcagacaggatcttgaatgctccgatctcgcttgtattggcaacatgtgtaccaccgcagaactcaatagagtaatctcccatatttacaacacggacgatgtcgccgtatttctcaccgaacagagcctgtgctccggtctttcttgcttcttcgatcggcatgtttttaatgacaaccggcagagatctggaaatgctttcatttaccatatcttctactttctgcagttcttccggtgtcattgccgagaaatgagagaagtcgaaacgaagtctcttgtcgtctacataagatccagactgttctacatgtgtaccaagtacggtacggagtgctttctgaagcagatgggtcgcactgtggtttcttgcacaaagcacacgtctctgcgaatcaacggtcaaagtaacctgatctccaaccttcatcataccctttgccatataaccgatatgaccgatcttgccaccaagcatcttcttcacatcttccacaacaaattcaccgtcaccgcatttgatcacaccgtggtcggcttcctgtccaccgcttgttgcgtagaacggagtctcatctacaaagatggttcctctctcaccgtcagaaagagcgtctacgatctcatcttctgtggtaagtaccgtaatcttcgattcatattccagatgctcgtatccgacaaacttagaagttacagacggatcgatggattcgtatacggttgcatctgctcccatgtagttcgttgccttacgtgcttttcttgcagtctggcgctgaacttccattgcagctttaaatccctcttcatcaatatctataccttcttcttccaggatctctttggtaagatcgatcgggaatccataggtatcatataatttgaacgcatcttctccggaaagagtctttgttccttcttctgccatcttttctttcatctcattcagaatgacaagcccctggtcgatggtcttctcaaactgctcttcttccttgcggatgacattcatgataaagtctttcttttcttccagctccggatatccgtctttagagccttcgatcacagttgcagcaagatctgtaaggaatcccggtgcaatgttcagaagtcttccgtgacggcatgcacggcggagaagacggcgaagaacatatcctcttccttcattagacggcataataccatcagagatcatgaaagatacagaacgcacatggtctgtgattacacgcagagatacgtctgtgctttcattatctccataagatactcctgcgatctcacatacctggtcacgcagtgcttttaaagtatcaatatcgaacatagagtctacatcctgtacgatacatgcaagtctctcaagtcccataccggtatcaatattcttctgcttcagttcgctgtagtttccatgtccatcattgtcgaactgtgaaaatacgttgttccagatctccatataacggtcacattcgcagcctactgtacatcccggtttaccgcatccgtatttttctccacggtcatagtaaatctctgaacacggaccgcacggacctgatccatgctcccagaagttgtcttcttttccgaaacggaaaattctctccggtgcaataccaatctcttcgttccagatcttccatgcctcatcatcgtcttcatatacggacgggtacagacgattcggatccagtccaaccacttctgtcaggaattcccatgaccagtggattgcttctgtcttaaagtaatcaccgaatgagaagttaccaagcatttcaaagaaagtaccgtgacgtgcagtctttcctacgttctcgatatctcctgtacggatacatttctgacaggttgtcacacggcgtctcggtgggatctcctgtcctgtaaaatatggtttcagcggtgccattcctgaattgatcagcagaaggctgttatcattgtgcggcaccagcgaaaagcttttcatttttaaatgacctttgctctcaaaaaagtcaagaaacatgcgtctaagttcgttaactccgtaagctttcatctttatcctcctcgcttctatcagctaaattctaattataaagagattttgatggcttgtcaatataatggaatttaaaaaggaaccgcattttctgcgattccttcttttttcattctacttagtctctgaattctttgcgtcttttcttttgcgaagcttcttgcctgcaaaaacccctccgactgcaaacactccgataaagagcatcttcaataccgtagagatcagtgttgaaaaaaatgccatcttgtcatgcctcccatgctatcattttcttttctccttgatttatgcatattatagcatatacaaaaaaattttccaaacttttttagcattttcacatacaatttcgaccttttgtatctgccttgcagttcctactccaccatgccaaaaaatttctgcgcatagtgtacggactgcatggcatcttttccatagaaatctgccccgatcatatccgcgtaatcctggttcagaacagccccgcctaccatgactttgcagtccggttttttctctcttaagagtttgatcgtctcttccatgctgactacagttgtggtcatcagcgcacttaagcctaccaaagtgacattctcctcaactgctttttctacgattgtctccggcggtacatcctttccgagatcgatcacatcaaaaccataattttcaagaagaactttcactatattctttccgatatcatggatatcaccttttacggtagcaaggatgatcttctccttcttttcttcttcctgtccggatgaagcaagcacatccttgataaccgcaaaggcaatcttcgcagcatccgcactcatcagaagctgcggaaggaagacggttcccttttcaaaaccttcaccgactacattgagtgccgggatcagttcctcctggatgatatccagcggttccctcgtaccgatcaggtcacgggtgatatgatgcgcctcttctttcagccctctctcgatcgcatatttgagtgtcatctcaacgcctgcagcttttggtgcatttccggctgctgcagctgcctgcgatgcctggactgtcaccgtctctgtggttcccgcataagtactgatataattcgtacaattttcatcaaagcccatcagtgcattataagaacgataagctttcatcatatcttctgaagatggattgatgattcctgccgtcagtccgttctgcattgccatcgcatagaaatagctgttgacgatcgggcgccttggaagtccaaaagaaatattcgatactccaagaacggttctgaccccgaattcttcccgtactctcttcaatgcttccagggtaacctttgccccgtctttttccgaactgatagtcatggtcagcacatcgatcacgatatctttcttgtcgattccgtatttggctgcttcgttgatgatcttacctgcaacacgcacacgaccttctgcatccttcggaatcccctcttcatcaatggtcagtccgacaaccacaccgccatatttccggatcagaggaaagacttcgtccatagaaacctgctttccgtttacagagttgatcatcggctttccattgtagatacgcattgcacgttccatagcctttccatctactgtgtcaatctgaagtggaagactggtcacgctctgcagttcttttacaactttttccatcatggcaacttcatcaatatccggaagtcctacattgacatccagaatgtgcgcgcccttatcctgctgcgtgattgcttctttcagaatgtagtccatatcttcatttttcagtgcttctttgaattttttctttccggtcggattgattctttctccaatgatacgcggcatatcatccaggatcacagcctgtccgtaagaagatacgatcgtatcatgctttttctcgatctcgcgcagcggaagatctttgcattcttctaccagctttttaatatgctccggtgtcgttccgcagcatccgccgatcacacaggctcctccttttacaacctcctgcatgatccgggcaaactcatccggctctacatcgtaatacgtttccccgttcttctgcttcggaagtccggcatttggcttcacaatgatcggaagggaggtatatcttcttaaatcgttcaggattggaagcatctgtttcggcccaagtccacagttcagccccagtgcatctacgcggagtccttccagcattgccacaacagaagggacatccccgcctgtcagaagctttcctctttcatcaaagatcatggttacaaataccggaagagaagaattttcttttgctgcaagaatggctgcctttacttcataggtgtcactcatggtctcgatatggatcaggtctgcaccgtacttttctccatagcggacggcttctgcaaatgcttcataagcatcatcaaaatccagatctcccattggttttaatagctttccggtcggtcccatatccagtgccacataagtctcttttccaatctgctctcctgctctttttgcatttgcaatccctgcgcggatcacttcttcaaccgtatatctgtcatcatgaaatttgcagacattagcgccaaaggtatttgcaagaaccacatcacttcctgcttcgtaatatctgcggtgaatcgcttccaccttttccggatgttcgatgttccaggtctccggaagttctcccggtgcaagtccttctgcctgcagaagagttcccattcctccatctaaaaataaaagttcttttcccaaacgttctctgatattcatgccctacgctccttaatttcttctgtaaatgcagtccttcttctcacacacttcgcagcctttgatgtggcatttttcctgcgtatcactgatcccaatgattgcagtcaccgattttgtcggtgtgagcatatagctgtctgtcatggtaagtccgatcttctttgccgtatccagcatccgtaagatatcgtcctgatgatggatatcaaaatcaccgtatcccggactaaatctcggtctgagccatttattctgtgcttttaactcttctccgatcgaaagctgcagatcgtcacagtactcctccagatatgcagctgcgcatgcctgcaatacaacagatttcgccatatctgtcagtgaataacgtttcatcagtatatcgacactggtaccgagtgttgcgccaaatacaactgcctctttgcagcctctgagattctttccgagacttctgcttttaatattcatttttccgatcgtcacctggtcttctcctgtaactttacagtcaaaaatgcgatagacggattttgcctgcgtagtctgatcgagctccccgaaggaaacatcgatcagcgcaagcgtctgttcatctaccgcatgtcttccatatcccagataacgaattgcttctttcgttctggcatctgtcatctttcttatgttcctttattttacgatttctgaaaggttctgcatgattgcagcagctacttccggtttattcatcgaatatacgtggatattgcggactccatttgcgatcaggtcaatgatctggtcggtcgcatatgcaattcccgcctgcttcatcgctgccggatcatctccaaaataatctacgatcgcacgaaatctctgcggaacagcagttcctgaaagggcacagcttcttgcgagctgctttttcgttgtgatcggcatgattcccggaagcaccggtatcatgattccctgttcacggatacgatacaggaaattatagaaaatatcattattgaaaaacatctgtgtggtaataaaatccactccacaatctaccttttctttgagataacggatatcatctttcttgtgttccatctctacatgtccttccggatagcatgcagctccgatgcagaagtctcccatttttttgatgtcttcgatcagttcacaggcatgagaatactgtcccggaagcggaaactgtccatcctgcgggatatctcctctgagtgcaaggatattctcaatcccttctttctgaagctgtccgataaccttatgtacctcttccttggttgaggatacacaagtcagatgtgcaagtgccggaatcttcaggtcattcttgatatgacttgcaatcttaaccgtattcttactggttccaccaccggctccataggtaacactaataaatgacggggtaagttctgcgatcccatccgttgcttttaacacggattcaaagcccgcatccgtcttcggtggaaacacttcaaaggaaatatgtactccgtctgctttaattttgtctataatcctcataacgaatgtttctcctctgtaaattttttcatttcatgataccatattttccggtaaattaccagaatgcattttacatattttcgtaaagttcttcgtaaagcttggctgaattcttccatgagaagtctttttccataccacgctctacaatcttgttccagtcacgcttcttgtcatagtaaatctgttctgcatatcttacagttgcaagcatctcatgcgcattgtaattggtgaagctgaatccggttccggtcttctcgtattcgttgtaagcttctacagtatctttgagtccgcctgtctctcttacgatcggcaccgtaccatatctcagactcatcagctggctcagtccacatggttcaaataatgacggcatcaggaatgcatcacaggatgcatagatcttgtgagacatcggctctgaataatagatctgtgcagataccttatccggatacttccatgcgaaatgacggaacatgttctcgtatctctcatctccggtaccgagtacgacgatctgaaccgcatcctggcaaagttcatccatcacacagtcgatcaggtcaaagcccttctggtcagtcagtctggatacgataccgatcatcatacggtgcggatctctctccagtccgagttcttcctgcagcgccattttatttttcactttctccttgcggaagttttcgacagagtaagttcttgcaatgttggtatctgttgccggattaaaatcaccataatcaataccattgacaattcctgacaggcagtttgctcttgcctgcatcagtccttccagcttctccccgtaaaacggtgtcttgatctcttccgcgtaactgctgcttaccgttgtcacacggtcagcgtagacaattccgcctttcagatagttggcattgtcatatgcttccagcttatccggtgagaaatagtatgccggaagcccggtgatatccataaccgtcttcttatcccagataccctggaatttgaggttatgtatggtgatcacagtcttgattccacggaaaaactcattgttatagcggaaattatccagataaatcggaacaagcccggtctgccagtcatgacagtgaatgatatccggtctgaaatccagaagtggcagtgcacttaaggctgcttttgaaaagaatgcaaacttctcaatatcgtatgcaatatcaccatatggcttcgaaccattaaaataatattcattgtctatgaaataaaaagtgattccttcgtattgaagttcaagaagccctacatactgctgtctccagttcagatccatatagaaatgaagtctgtaagaaagtttatctttccattcgtctttcatgcacatatactttggaagcataacacgtacatcgtatttgttcttatcaaaatattttggtagtgatcccactacatcggctaatcctcctgttttgataaacggaactgattcagatgacacaaataatacttttttcatttaacaccctccttactctcgcggcttacttataattataccgcaatttcatccgtttgaaaagaattatctgcgctttgatttcagtctgatcgtgtctgcgaccagagcaataaattcagaattggtcggttttcctttcccgttacttactgtgtaaccgaaaagagcttctaaggtatccagctttcccctgctccatgcaacctcgatcgcatggcggatcgcccgttcaacacggctcgatgtggtctggttctttttcgcgactgtcggatacaggatctttgtgatcgcatttaaaacttccatatcgtcaaccgccatcagaatggaatccctcaaataatgatacccttttatatgtgccgggattccgatttcatggagcagttctgtcacctgtgtttccaggtcctcctcagaaggttccgcatatacggtataatctgtgtaaggcgctacactcttttccgcatgtccggagcttttgatccgctgaaggattgtttcattgcgaaatggtttcaggatgtagtaggctgctcctttttcgaaggcatcttccgtgatcctctcctgtccaatcgcagttacaataataaaattcggctgtttctttactgttttatctgcgcctatcatttccatcacactgattccatccattttcggcataatcaggtcaagaagtacaacgtcaggctgtttatctcttataatgtgataaatatcttctccgttcctggcttttcccaccagtttgagatctttatcactttctacaatttctcctagtaaattcaacattctttcgttatcgtcagcaatcgctacattcagtttttccataaagcctttcccctccttaaagtgacaatttgcactggaatgtaacctattataaccttctgtattctgcgaatacaagcaaatggtgtcgcagaaatctgacaaggttcgcatatttcaatcttttttcagattttccagcatgttttcgataaatattccgtatccttttgtcgcatcctgtacgaaaacatgtgtcactgcacctataatctttccattctgcatgatggggcttccactcattccctgcacaatcccaccggtcagtttaagtaaccgtttgtcagtaacctgaatttcaatccccttgttcacctccctggcatccaggtcaacttttgtgattctgactgtataatcttctgtctttccgcttaccgcacagcggatatacgcctttccgacctgaatttcttcctttgccacagccggataagcttctttgctgtcaaatattctctcaatcctgtctaatttcccataaatccctgtctctgtgtttgtagtaatcgaacctaaaatattgtaatgattgtagacaatgatcccttccatccctccaggatttccgttctcaccttttttaatattctgaatgctggtatcatataatcttcccgttgacatttcgatcagtttgccggtatctacatcatgtattccatgtcccaacgcaccgtattcactatccgcattcagaaaagtgattgtgccgagtccctgcgcgttatcacgcacccagattccaagtttatatgccccgccttcatcttttgtcggatgaagttgtacatcaatatacactttttttcgacgaatgtgtaagatgacggacttattcgataattttttaacccgttcgataagctcagatttattataaatactgtcagaatcaactccgacaatataatctccctccttcaccagatgcttcgccggattcacaccgatcccatcttttcccttaatttcctgcgtccccagcaccatcacgccatccgtctccatatagatcccaaccggcatccctcccggaatcagaaggtttcccgaaagttcactgaccgaagcctccctctccgctttctcagcccgccattccctgtagcaatagccgcctcctataaccacaattaccgctaataacacacttaacattttccgataacttctaaccgacattacacacccctttttccttcctaaaattccgcaaaaaataaggcaggattttttctcctgcctctagtatgtgctcaatcttattttttcaaaccggatgccagaattttcatctcccgtgcgttttccagcaccgcatccgtaatctttgcgcctccaaggatccttcccagctcctgcacagattcttccccgtcaagctgccggatcttggtctttgtcatctgatcttccacccgtttttcaatcaggtaatgagtatctgccattgcagcaatctgtgccagatgcgtaatgcagatcacctgatgtttcctgccgatcaggcacatcttctcggaaaccttctgtgcggtacgaccgctgatccccacatcgatttcatcaaagatcagtgtctcgatctcatctttatccgccatgactgccttgattgcaagcatgatgcgggaaagttcaccgccggatgccacagttgcaagcggtcttgtcggttcacccggattcatggagatcataaattccacctcatccgttccttctactgtgtacccggaggtttttgaaaaccgaatttcaaagcagacatccaggaaattcagatcctgaagtccttctgcgatctttgcctgcaaaagctttgcctcttttttacggatcttcgacagaccctcgcattctttttgcagacgttcctctgattttttcagttttccctttaattcatttaaatattcatcataattttttaaaatcaggaggcgctcctcgtcatccgccttatgctgcaggattgcctctgccgaatctccgtatttgaccttcagatgattgatctgattcagccggctctccgtctcatagaactgttccggttcaaaggaaagactgtccagataacagcgaagctcgcgcccggaatccccgatcagattctccacttcgaccagctgttcatacagttctctcgatttgtcatcatgttctgccgccacagctgccgcacgtactgcccgtccgatcgcttctgccgcacttataccgccttctcctgctgtatacagatacgcctcttccagattctctgcgattcttttcccctgcatcatccgccggtaatcttcttctaccgactggcattctgccgcagtgattcctgcattttcaatctcatcaatctcaaattcaagaaaagaaatctctttggctctctcagcctcgtctttatcggcttccttaagttctttttccagccggcggtattccctgtatgaatccgccacttttttcttccattctccggcttcttttgcaaatgcatccagaattgccagatgattttttttatataacagtgactgatgctcatgctgtccgtgaatatcgatcagaacctgggctgcttcctttagccgccccagtgtcacagtctctccattgatccggctcacacttcggtttccgttaaaccgtctggtgataatgatctgccctccgtccggcgaaagatccatctcttccagcttccgtaccgtttccggattttccacataaaaggtcagttctacaagtcccttatcggctcccttacgaagcatatctgctgaatatcttccgcccagggcaagactgacactccccaggataattgattttccggcaccggtttccccggtcaggatattgagtccaccagagaaatccacttccgcctcatcgatcagcgccagattttttacatgcaaattttgtaacattctttctcctgtctattgttccagtagtttcttgatcttttccatcagtagaatcgtatcatccacggtccgcacagcgcacatgatcgtatcatccccggcaatacagccaacaatctcattccagttcatcgcatccagtgccgcagccaccgccatcgccataccggataccgttttcagtaccagaatgttctgagccatatccatagagctgaatccatcccgcaaaatgcgcacatatttttcagtcattccgttctgtgcactctggagtaccgcatatttctgcctgccgttttctgccggaaccttggtgagctttaagtcgcggatgtctctggataccgttgcctgcgtcactttaaatcccgcttcattcagatactcggcaagctcatcctgtgtctcaatctgatatttgttgatcaattctacaattttggcatgtcggtttactttcatcttctagtttcctttcatcttttcacgtaatgtttccagaaagctcactttgctgagttttacgattttcgctgtctcccacgcctttttgatccggatccggtcaccggtatgaagcgggacttcatccgcaccatcatatgcaatcactgcttcctcgatctgattttcccgttttgcaccaatctcgatcacgatctcatctttgtccgcgaaaacaatactgcgggaattgagtgcatgcgagcagatcggtgtcacaacgatcaatgacgctgtcggctccacgatcggtcctcctgcagacagattgtacgcagtagaacccgttggtgtggacacgatcaatccgtccgcatcataggagttcagaaactctccgttaacatagagattaaaatgaacaatcttcatgctgccggatctcgtcatgacaatatcattgagtgccacatcccttacattgcggtatgcagcggatccatacagcatcatcctctcttcaatcgtataattgccctctacgagctgttttacagcctcttctacattctgcacctctacctcggtcagatagccaagggtgcccatattgattccaagcatcggaagctcccgcccgaacagacgtctggatgcctggataaaggttccgtctccgcctaccgtcaacacacaatcaatatcctttggaatcttgatctttgaaaaatttccttcttccggctgctcttccagataacatttcttcccgtaggattcaatgcatttttttattttcacggtgatcttccgatttgcatccttcatatcattcgtgataatgtaaaacttttccatgtctttttatttcttctcctcagccggatcctttttcgcaagtgtgtcaaaagcagcatcgacagtcccccgaatgtctacgctctccacaatccttgcctcttcctccggcctttttttcagatgtaccagatactcgatattcccttccggtcctttgatcggtgaaaattcaagtgctgctacttcaaaaccgatcgatactgcataattggttactttttcgatgacctcgatatgggtactcttttcccttaccacaccttttttcccaaccttctcacgtccggcttcaaactgtggcttgatcaatgcaacgatctctccgttctctttcaggtaattgcggattgggagaagtaccttcgtcagcgaaataaaagaaacatcaatcgatgaaaaatcaatcggttctcccagatcttccggctgtacataacggatgttggtcttttccatgcagaccactctttcatcctgacgtaatttccagtccagctgaccatgtcccacatcgatggcaaacaccttgactgctccattttgcagcatgcagtctgtaaatcctcctgtcgaagatcccacatcggtacatacctttccttccatggatacatcaaaattcttcatcgccttttccagcttaagtcctccgcggctgacatacggaagtgcatgtccacggacttcgatctgaacctcttccgaaaaggaagttcccgctttatcctctctctgcccgtccacgaatacattgccggacatgatgatcgcttttgccttttctctggaggatgccagatttctctttacaagtaatacatccaaccgttctttcattctctatcaatccctcctgctctcttctgctatatatgcagtgataatcctggccacgcaggattcaatatccagcatcacctcactgcgaagtaggtctacacttccgtgttcgatatagtcatccggcagtgccagattcagaacctctgcgtctgtctcaagacctgccagataagcagtcacaaattctccgaatccgcctctgcggatattctcttccagtgtcacgatcagccggtgttccaccgtcagtttccggagcatctcctcatccaccggttttacaaaccgggcattgatcagggtacagttatatccaatctctttcaaacgcttccgaacctgaactgcctgctcaaacatatgtccgacactgatgatcgcaatatcctcttcttcatagaccggctcactctttccatactcgatcggtgctctgtattcacggaatccgtcaaatgcgctgcctcttggatagcgcactgctaccggtgctccaagtctcaccgcaaaccgcaccatgtccgccagttcccatttatttttcggagaaaggacggtcatattcggaatcattgacagataagaaagatcaaagatcccctgatgggtctccccgtcgcttcccacaagtcctgccctgtccacagcaaatacgaccggaagcttctgcagacagacatcatggatcatctggtcaaatcctctctgtaaaaacgaagaatatacagcaaataccggatgcagtcctgccgcagcaagtcctgccgcaaaggtcacgccatgtccctctgcgatccccacatcaaaaaagcggtccggatagtatctgtgaaatgctgccaggccggtaccgtcttccattgccgccgtgattgctaccagtctgtcatctttttttgccagatccagcataaccttggaaaacacatctgtgcaggaatcctttccacttttggaaatcggccctcctgtctggatatcaaacggacctgttccatggaaacgggaagggttttcttctgccgggagataccctttcccctttttcgtcagtacatggacaagcaccggtccttttaccctttttgcctcggtaaacgcacggcgcagcgccttcaggtcatgcccgtccaccggtcctaaatacttgattcccatatcttcaaagaacattcccggaaccaaaagctgcttgatgctgctcttggtgcgcttaatatgccgcaccatcttttcaccgccaaacggaatactgccaagtacattttccacggtatccttcaggtcggtataggcctgggcagtgcgcagctccccgagataactggacattccaccgacatttttggaaatagacatatggttatcgttgagtacgatgatgaaattcgtcttcatctccgcagcattattcagtgcttcataagccattcctccggtcagtgatccatcaccgataacagagatcacggaataatcctgtcccaggatatccctccctctggcatatccaagtccggccgaaatcgaagtggagctatgaccggtatcaaaggcatcacagtcactttctttcctcttcgggaaaccactcataccgccgtattttctcaaaccatcaaatccttctttccttccggtcagaatcttatgcgtataagactgatgccctacatcccagatcatcttatcctccggaagctgaaaactgagatgcattgccatggtaagctctaccacacccagattggacgcaagatgccctcctgtcttgctgatcttctcaacaagaaaagtacggatttcttctgcaagccctgccagttcccgttcatttaattttttaatatcattcgcttcgtgaatctgctccagatacacttcatccaccccgcttattttttcctgtgtatcagttcccgtatcagctgtgtcagatacgtattttctctgtccagcccggaaagcagctccagtgcttcctgcgaaataacttccacatctctggttgctttttccagaccttttaatgtaacataggttgttttttcattcttttcatcgctgtggaccggtttgccaagctcttctgtagtacttgtcacatccaggatgtcatcctggatctggaaagcaatccccacacccgatgcgatcttctgcactttctcaagctctgcatcctctgcacctgcaagaagtgccccgatcatcatcgaactttcgatcagcgctccggttttcagttcatagataaagttcagcatgccttcatcaagtcccacaccgcaggaagccacatccacgacctgaccgcctatcatcccgtaaataccagctttttctgcaaggatttttaaagcttttccaatcagaagactcttttcaggtgcgatttcaaatgcctttaccgccgtctcaaacgcatagttcagaagtgcatccccggctagaattcccattgcttccccgtatacgatatgcgttgtctttcttcctctacggtactcgtcattgtccattgccggcagatcatcgtgcaccagggaataagtatggatcatctccattgctgccataaacggctcgatttcttttccttctcctccgaaaaggcggtatgtctcctgcatcagcattgggcggagtctctttccgcctgccatcacactgtactccatcgcctccatgatctggctctggtaaccttctgctttcggcagatattttacaagaagcttttcaatcacttctgttctttctttcatttcttctttaaaagtcatgtatttctccattctcttccagcacctgcacttttttctctactgtatcaatcttctcattacaaagcttcagcatttccatacccttctgatacagtccgaaggactcttccagcgaagtatctcccgattccagctcttttgccacctgatccagctttgcaaaaagctcttccagagattcttccggcatttcttctgcaatctcgtttttcttatctgccattttcctactccttcttggtatctgttacctgtgcctcgatctgcccgtctgtcacataaatccgaagccagtctcctttttttacatccgctactttctttacggtcccttccgatccctgtacataggaaaagccctggttcagcttggcaagcggagaaagtcccttcatccgttcgatccggattgcaagctgctgacggctttcccgcagattccgctccatcagaagcggcagcatctcctgcactttccgagtcctctcctgttcccgttccaaccgctgatgcatggcttttgggatctgctcctcatagtctgcaagctgctggcgcatggacttaagtttccctgacggacttaagtaacggaatttttctgcataccgcgctgtatgaagtgatgcaacctccagctttctcctcatacttcggtgcatcctttcccgttctgtccggatcgtttccagaagttcccggtaattacagattgcaagctctgccgcagcagaaggcgtcggtgcacgaagatccgctacataatctatgatcgtcgtgtccgtctcatgtcctactgccgaaataaccggtacactgcattcaaaaactgcgcgcgctacattttcctcgttaaatgcccacagatcttcaatagaccccccgcctctgccaacgatcatcacatcaaccttagcttcctccagtgcacggattccccgtaccacactttcagatgcgccatccccctgtaccagtgccggatacagaagaatctgcacatatggatttctccgcctggtaatgttgataatatcgcgcactgccgctccggttggtgccgttacaacaccaactgtccgcacatatttcggaatcggctttttatattccggcgcaaacattcccatttcttccagctcttttttgagctttataaatttttcataaagaagtcccgcaccatccagtacgatctcctttgcataaacctgatatctgccatctctttcatagacgctgacgcttccaagcacgattacctgctgcccttcctgcatacgaaaagaaagtccgctgcgctgcccggcaaacataacacaggcaatcgttccggactcatctttcagtgaaaagtacagatgtcctgaagtatggtacttacagtttgacacttctcctttgatataaattcgattcaacataaagtcttgcgtaaacatattcttaatgtacgcattgacctgttttacagtatatacatttcgcatgatttctgattcttatgcaagctttccgagtacaccgttgacaaatgccggtccctcatctcccgaaaaattctttgccagctcaactgcttcattgatcgctactttgaccggcacttcgtcatcccacttcatctcatatacggcaagacgaagaacagaaagatccactttattcatacgtccggttttccaaccggttgtatgttcattgatcatcgcatcgatttcttcttcgtgtgctgcgatatctttgacctttttgcgcatatatccgcgttcttcctcacttgcttcttctacctgttccagatacagttcgatctgttcgtctgcatcagccgcatcaaatccgatgctgaagagcattttaaatatatgttctctgactttacttcttcgcatgttctctctccaattattcttcttccggcatgtccacacctgcaacacggatgtttacgtctgcaacggtaagacctgtcatattctcgattgctgcctttactttttcctgtacctttaaagtagtatctttgatactgctaccatatttgaggttcagggcaagggatacggtaacgataccttccagcacgtctacctttactcctttggaaaggctcttcattccaagctttgcgatcagttctctggttgcatttcctgccatggaagataccccctctacctccattgctgcaagtcctgcgataattgcaactacttcatcagcaatctgtacttctccgaggttctcatctgattctatcttataggtatttctctcttctttactcattataagtcctcctgtctgcggttcttccgctcctcgcgctcatctcggaacctttcggttcctcgatgttcgttgcactcacatagtcctggcttgaaaatgatccgtctgcaagcagccgatcactttcttcccttccctgcgctcgtcgctatgcgttcattgtaacataaaagatccttattggaaagttttttaggaacgtccgaattcggaaagtttcagtccttcgtttcgttccagcaccatacggatgctccagctgttgacaaacagaagaagcggtctgtctttcaggtccttgatcttcttcatatcggatgtgccgaccagcttgtccatattgatttcttcattctcgatccagcggatatgttcgtatggaagtggttccagacggatctccacgttatattcattttccagacggtattttaatacatcaaattgcaggacaccgactacaccgacgatgatctcttccataccggtgttgaattcctggaaaatctggatcgcgccttcctgcgcgatctcgttgattcccttgatgaactgctttctcttcatcgtatccacctggcgtactctggcaaaatgttccggtgcgaaagtcggaattccttcatatgcaaatttttccgctgaattggtcagtgtatctccaatggagaagataccaggatcaaatacaccgatgatgtctccaccataagcagtatcgatcatgtggcgttcactcgccatcatctgctgtggctgtgacagacggactttcctgcctccctggatatggaagacatccatgcctgccttgaactcaccggaacaaatacgcataaatgcgattctgtcccggtgtgccttattcatatttgcctgaatcttaaacacaaatgcggagaaatcttcttctttcatcggatcgatcaatcctttgtcggacattctcggaagcggcgaagtcgtcattttaaggaaatgctgaagaaaggtctccacaccgaagttggtcagagctgatccgaaaaataccggagagagttctcctttgctgaccatctcctggtcaaattccgcactcgctccgtccagaagctcaatctcttcttccagctgtgcgaactgtgcttcacttacgatgctctttgcttcctcactgtcgatggaaaccttctcaacttccccgatcgaggttcctttcttggtatctgagaaaatctccagctctctgctgttccggtcaaatacgccgcggaattcttttccggaaccgatcggccagttgatcggacaggtagcgatccccagttccttttcaatatcatccagtaattcaaaggtatccatcgcttcacggtccattttattgataaatgtaaaaatcggaatatgacgcatgacgcagactttgaacagctttcttgtctgtgcctccacaccttttgatccatcgatcaccataaccgccgaatcggccgccataagagtacgataagtatcttccgagaaatcctgatgtcccggtgtatccagaatattgatgcaataaccgtcatactggaactgcaggacagaagatgttaccgaaatacctctttctttttcaatctccatccagtctgaaaccgcatgtttcgctgttgcctttccttttacagaacctgcctgattgattgccccaccatataacagaaacttctctgtcagggtagtcttacctgcatccggatgggaaatgatcgcaaatgttcttcttttctttatctcattcgtaaaatctgccatgttattctactcctactattttctcaatgtcactcaaactcttattatatggtatttttgctataatatcaatcccctgattcactcgtatttgtactttcatggatcggtgtgatcaccacatttgcagcatttacctctgctttgcgtgtgacaatatcctcgatctgtgcccgttttgcatccgacagatccgccacatcaacgaccacatctgcggattcttcggtaagacttaccaccgcatcctgaaagcctttgctggcaagcagagtctcaattgcaacctcctgttcggcgcgctgtgtcatctccaccatctgcgcaactgcatctgctttctggtcttctgcgatatctgcattatcaatgatcgcctgcagggtttctttgttttttgcccgcacctgctcccggttcacttttgcctgtgctacaagcgcactgaccgatccatttgtcagcaccgcctctcccggatttccgtccacctgatcgttatccgctgtctggagggagctgtcacctcctgtgtcctgatccgaaatatccagaagttccttatttgccatctcgcttcccgtctctgctgttttgtttttcgagccaaaaatttttccggaatagttcagatatcctgccgcagcgatcatcaccgcaagaaccgcaatcacaatctgatttttcttaaatacttttttcactagccttcctcctataagattcttttttagttatgcttcattacttttatcttatgcgtgtctactccgaataatgcctgcacagcctctgtgatattttcaatcacgatggcattatctccgccatctgcaattacgagaacaccttctatccggggacttaattcctgtttcacatatggcgtttcttctccatttccgtttgcataaactgccgtctctgaagaacttgtattttttcctccgctctccccttcctgcacctcacttgtcatctcctgatccttttccactaccttttccgaggaagaagccagagtgatcatcacctttacatttccaactccttctacttttgcaagtgcattttccagccgtgtttccagtgcatctgtataagtatcctccgatgcattttccgccttctgcacctgctgttcatcctgtgtctggtctgattttatatcggaaacaggcatcgcgatcacaaccagaagcagtccgacaagcaatatgatcaaccacttgtctttttttattttacggatttcaaacatcttcattcaccgcccttttcgagcaaatccgccgcatactccatctcttttatcatctgctcatactccgccgtccgatacagctccgttacctgtccggcttcccccataagatccagaaccggctgggcaagcagaactgtcagaagaagtccgcagaaaaaacggacatatttccggtagctattctctggaagtgcctgcaaaaatgcggttacaagaatcatataaacggcgagattctgcatccacctgtaaaccagctgtatcattttatccctcctacgaagctgccgatgccgcaactgcaagtgtcaccagaaacaggaccgccgtcgcaagcaccgtctttagcagcatatgataaccttccccggtaaaactgatggcctccacgatccgtttatcagacaccggctggataagtgccgccgttcctttgtaaagaagcgtcagaattcccatattgatgaccgggatcatcacaactcccgttacaagcagtgcccctgcaattccaactccattttttaaaagaaccgcacttccaagcacgacttcgcttgtcccgctgactacatcaccgattcccggaatcattctcacgccctttgtccagacactccttttcacctgatctgccgccggactgattatccgctcgataaacccgatccccgtcaccagggcaagcagacttttcagactccatccgattacaagtcgcaaaagttccgctgccttagaaagaaattcctcctccgtcagattgttcaagatttccatcagaagtgcgatctggatcaacggaacgatccatttcaaaatcacaagttccacaagaaaaatcaggaaaagcgccagattataaaatgcgatcgcagaaatacttcccactgcgactgccatacagacaaagtagacaggacagagtactcgcataaagaggatcagattttcgagtccatgctgtacctctacggctgctgcctgaaaattccgtatgccgactgtaatcacagacaggtataccagaaaaaaggcggtctgtgagatctggcagttctgaaacacttccgaaaagttggaaaaaaccgctgcgatcagcaccagaaaaatgatagatgcaagcaccggtttattgaccttcagcacatagaaaaactgatccgtcacaaagtttctgatctgtccggcagacaggttctcatcctgccggatcacagactcaacaagatcctgaaaatgcagtttttcttccgggaacagtttccggattgccatatccagatcctttatctctgtcagctcccagattttctgctctgtttcctcctgtgttttttccagatccgtttctgtcatattatcttctgtccggctgttttccgaagaggaatcttcccctgccgcaaatacctgtaccggcagtatcagtacgaagattacaagtccgatcatgcatgctatgccatatttctgaaaataatgtttcatttttcttcccttttactgtccaagttcgcggattgcaagaagcagtgcttttaatatcggcattcctattgcaagtatactgagccttgcaaagacctcgatctgcccggcgatcgtctgataaccggcatccttgcagattgctgccgcaaattccgccagataggtcacacccaggattttcagcattgccgtcagatataccgcatcgatctttacaaagctgccaaccaattccaaagtttcccggatcaccgacagattccggctcattccgagaaaaaggaaaatgctgaccgcaatccccagatagatcccatactcttttctggtattttgaaattgtaatgccaggaaagttcctgcaatcccgatgcaggctgccttaaggatactcatcttttccctcctttacagagcaaagagccgtctgatatcgtcaaacagatctgaaatataaggaaggatccagaataaaaccaggagcagtcctgcaaggcttgtgagaaatgcctgttcttctcttccgctgtgtttcagcacctgtcccaggacagaaaccagaatcccgactgccgcaattttaaatatcagatttacactcatgtttcgctcctatttacagaatcaaaattgtcaggaaaagccctgctgtaacacccagcagattgcaaagcctccgtttttcctgaatttcttttaaaagaccgcctcttttttcttccagaaattctgcatactgcaagaaaatctgcgtttcctgcttcttatccaggctaccaagctgcatcccaagctcatgcagacgtaccctttcctccctgccaagaagcagacattcaagatcactttcgcagcacctctcccagattattgcaagacttcttgacggcatctccaattcttttgccagatgttccaaccagatcctgtagttctgactgcatcttcgggaaacagaagcgcatacctgggcgagtggtgcataagtatactccatttctcccgcaagctgccttatcactctttgcaactctccggtatccgtgatctgcctttgatattccattcccctgctgtatccatagccggatgtcgccgccacaattcccaggcatccgaccattttcagatacacagtttttctccccgttcgttataaatcccttcaatttctcctacatgtttcccggatttcatcacaacatatctggcaaagcatctttcctttaccagattgctgaccagtggcttttcacggatctcatccataccggaaccatgcaccgtcgtcagcatggttgccccacagtgcatggcgtactcgatcgcctctacatccttcgctgtcccgatctcatctgccgcgatcacctccggcgccatggaccgcaccagcatcatcattccttctgctttcgggcagttgtccagaatatctgtccgcatcccaagctggttctgtggcacgccacggtagcatcccccaatctctgaacgttcatccaccacacccacatttcttccttccacccagcggttcccatctgaaatctgacgcaccagatcccgcaaaagtgtagtctttcctccacctggtggggaaatgatcatggtatggcaaagtcttcctttttcaaggatcacaggaaacagcttattcgcacaacctgtaatctcatggcagattcggatattgatcgatgtaatatactgaaaattcctgatctgttccttttccgaaataattttcccggaaattccgacccgatgccctccttcaatcgtcagaaacccctggcgcagttcattttcataggcatacaaggaataattggatacatattccatcgtttcacgcaattcttcttttgtcacccgatgggtaaaaagttcttcctttccctcttttttcactgcaagcggctgctcttcccgaagccggatctcctggatcttctcaaaatccagtccatgattcaacaggatccctcggattttctccggaagcaccgccagaatttgatctttcttttctcttctcatcttgtccacctctctttaaagaatgtatatggaaagcaggagaaaaatagaactgattttgtttcataggaagttccttcggaatttcctatgaaataaaaaggagctgtcggtaaataacgttttttagagctgacagcaccaaacaaaaatatcctgacagttacagagctttctggctctgcaacttggtcaggatatttttattttgataaatactttctgtttttggccgcaaaaaatccttgtttggattttttcagccgcatttttttctaggcagtttttccttcaaattttctcagtttttcgtataaaaaacgatgatatttatttatatttcttccaatagcatacagcatgaattctttatataccttatctgccgaacggtaattaaaacgccggaagttctcattttccttgatatctccaaaatgtccttccgtctgaatggaacgtgtctggcgtttcaggatcccgcgttcactctggatattggcatgcgatctttctttcagttcctcccattgttcattgatcttcatgactttgttcttttcggcatctttttccgcatcatacttatacagacagcgcgctttatgttcacatccgctgcagtctgcacaaccatatacctcaaaggtctgtgtatatccatcctgctctttgctctctgtactgagatgccgcagttcacgtccgtcatggcagatatagaactgttcatcttcaaagatccctgtccgcatgttgtaatatttactgatatcttctgaataagcgtgtgtttttcgcttttcatgatcctgcagttttatataactggatatttcattccgttttaaataaagcagatttttttcactacagtacccgctgtccgcagttacttcttccagaatactcccgaaagcattcttatgtttttcaaggaccgggatcagggtattataatcggtgcggtcgctgcttacatatccatgtacgataaaataattctctaccgcgatctgaacattatatgctggctttaactgtccgttcagcatgtgatcttctttcatacgcataaaagtcgcttccagatctgttttggaataactgtttctgtcttttcccatgatctcaaagcattctttatattccatcagtcgttttccgcattgttccagttcctcatgcagctgttgaagtgcaggttttctttttccttttccgtaaacgaattcgatttcctcgttgtctgcgatcatcgtgagattgttctggagtttccgtatttcaagcggtgaacagttatcgatctctataatacggttatttgaaagctttttatgttttacaagctttcgttttctgttcttttcgatcacttcccggactttatccatcccttcgatcacaaacatctgtgcatttcccagctcgtactttgttccataatcattctcctgcaaaaaagaattatatttttcaaaaagctggtcgatagagtccagaagtcctgccagatggtaattgatgcttccgcgccatacaaaagtataacggttcgcatttgcctctatctttgtaccgtcaataaaaagttcttttaatgtgaccagcccttctttctgcagccgccgcataaactggtaattcaggtcatccaggacagcagatgtcagcttcctgtttttaaagtcataaaaagcatcacgtttcggtttttgtccgcgcgtcagccagataaaagcaaggtctctttcacacagatcaacaatacggtcaacagaacgtattccacgcatatttgcataggtaactacagcatacatcataattgggttgtacccggttcttcccttatctgaacaattggctaacaagccagaaaaatctaattcctccatcacttttttcagggtatagactggatcgtcgtcaggtaaactcaattcgaagaaactaaagttaattttctgttgcccaaactcaaaaaaatcgttataataattagttgttagcatagttacattataacatgtaacggagagaaagatggttgtcgttagccatctttttttcttttttcagataaattcagggagggtatgactcgttgtgagtcataccctccctgctttggaactatctatttcccgacagccccttctgattttataaaattttattctgcaacatctttgatgctgaagctcaaacgtcccatcttgtcttttccaaggcaaaccactttgacgtgatctccgatagaaagaacatcttctacatggtcgattctctgcttagcgattttggaaatgtgtaccattccttctttgcccggtgcaaattcgatgaatgcgccgaattctttgatgcttacaacatcaccttcaagaaccattcctgcctcgaagtctgttacgatggttgcgatcatctttcttgcctgttccatgctgtctgcatctacgccacagatagatacacttccttcatctgtgatatcaatcttaacgcctgtcttttcgatgattgcgttgatggtctttcctctctgacctacaacttcaccgatcttagccggatcaatattcatctgaatgatcttcggtgcatacttgccaacctgtgctcttggctcagcgattgtcttagccataacttcatccagaatgtaaactcttgcttttcttgtacgtgcaattgcttcttcgatgatcggtcttgtcagtccatggatcttaatatccatctggatcgctgtgatacctttatgtgtacctgctaccttgaagtccatatctccgaagaaatcttccagtccctgaatatctgtaagtaccagataatcatcgtcagtagcacctgttaccagaccacatgagatacctgcaactgcagatttgattggtacaccggctgccataagtgacatagaagatgcacatacacttgcctgagaagtagaaccgttagattcaaatgtctcagatacggtacggatcgcatatgggaattcttcctctgacggaagtaccggtaccagtgctctctcagcaagggctccatgtccgatctcacgacgtcccggtcctctggaaggtcttgtctcacctacagagtatgacgggaagttatagtgatgcatatatctcttggatgtctcagattcatccagtccgtctaccttctgtgcttctgaaagcggagccagtgtggtgatggtacagatctgtgtctgtccacgtgtaaacatagcagaaccatgtactctcgggatcaggtcaatttctgcggcaagtggacggatttcttcgattgcacgaccgtccggacgcttgtggtctttgaggatcatcttgcggacaaccttcttctggtactgatatacagcttcaccaagtttggcaagccattcttcgttatcagcaaaagcttcttccagcttttctgtgatcttacggatattttcttctcttgtctgcttgtcatctgtgaatactgcaacttccatctcttccggtgttacgatcttctgaatcgcttcaaagagttcttccggtactgcaaagcttacataatcatgttttggttttccacattctgcaacgatctggtcgatgaatgcgatgactttctgattcacttcatgcgccgcgaagatggcttcgagcatcttagcttccggtacttcatttgctccggcttcaatcatgattaccttttctcttgtagatgcaacagtcagtgcaaggtcggacttttctttctgctctgcggttggattgaataccagttctccgtcaacaagtcctacctgggtagaagctgtcggaccatcgaacgggatatcagaaatagcagttgcaatcgctgatccaagcatagcggtaagctccggtgagcagtcctgttcaacagagagaaccaggttctccaaagttacatcatttctgtaatccttcgggaaaagcggtctcatcggacggtcgatcacacggcaggtaagaacagcattttctgatgcctttccttctctcttgttaaatcctcccgggatctttcctactgcataaagcttctcattgtattcaacgctgagcgggaaaaagtcaattccttctcttggtttgtcggatgcagttgctgttgaaagcacaactgtatcaccataatgcataagtactgcgccgttcgcctgtttggcaactcttccaacatctacgcggagtgtacggcctgcaagttccatttcaaactttttgtacataaatgttctccttttttatctgtttatctgacgggtaaaatctccgaaactactgaaaaatacacttctcaaaatatacttttcagtggtctcggacgcaatctctacccacaatcttttgtattatatcatatccttacatctcttgcaagattctatataactaactttaaaatgtggcaaaacacggttattggtcactcccatgtcaatcactatgctgattggcatggatgatgcatgtcgtaccggttcggctcattgtttgcgtaaacaaacagggagcgaagacatccagctgatgcctttcgctccctgtaaaatacgtcttactttcttaaacctaatctttcgatcagtgaacgatatctttcaatgtcattcttcttaaggtatgcaagaagtcctcttctctgtccaaccatcttaagaagtcctcttcttgagtggtgatccttcggattagctttgaagtgatctgtaagatcattgattcttgctgtaagaagagctacctgtacttccggagatcctgtatctccttctgttcttccgtattctttgataatctgttctttcatttcttttgtgatcatttgtcactacctcctaaatatactgttaattgcctgatattaagcagtggttggagattccatctgccgaacatcggtttttcatacttgcctagtgtaccatatgccccgaatcctgtcaagaaggattttatctttcccgcatctggcaggttttcatattcctgttcacaggctgcctgtaaataaccgcatttccagagctttttcaccggctctgttatttcttatgatgataacggaaaaattcttttgcgtaagcaatatcctgatcgatctgtgccttcatcatttctaccgattcaaacttctgctccggtctcttaaaatgataaagctggatctctacctcttttccgtaggcatcaccactgtaatccagcagattgctctcgatcagcatccggttctcatcggataccgttggcttaaacccgacattaccgattccgttgtaccagattccatcaatcctcacactatccagataaactccgttcggtggaagaagtttatcccttgacggatgtacattaagtgtcggaaatcccagttttctgcccagctgcctgccatgctctacttttccccgtacagtatatgcataccccagcatatcattcacagcttccatatttcccttccgaagctcttccctgacatagctgctgctgatctcccgttttccgtacatctctttttcaatcacaaaaagttcatatccatacacatcggcatattctgcaagcatttttgcatcaccacgcttgtcatgcccaaagtggaaatccgttccgatcacaatataccgggcatgaattttctcaatcaggattttccggatgaaatcctctgccgacatacttgtaacatcttcggaaaacgggcattccagcagtacatctactttctcgtccagaagacatctgcgctcctcattggacatgatcccttctcttgattttccaagcttttcataaagcggattcatatcaaatgcaaacacaacagaacgaacgccttttttcgccttcagctgacatacttttttgatcagcttctgatgtcctctgtgaactccatcaaatttgccgagtgtgattgctgcctctctggaatcctgataggcttccagccctctgatatagtccatgttctttcctctttaattactttttttcatttccatcaaaaaacatttttacaatcttgaagagatcgtctttcctgcagtaacagtaaatcgcaataaactgatgcgattcatcgtacacgcggactctctcatcgttctcatactcctttaatgctgtttcctgtgaaatatctctttttctgaaactattcccgttccgtactgccgcggccgtttttggtggcagtacgacctgtgcatacgttggaaacatttcatctatcgcaatgatcttctcctccagagtcccttctttctgaagctgtgcaatttcaccgagccggatactgtcttcaagtccaaaccgctctacacgtgttctcaaaagctctttcatgcatccgccacagccaagcttctgaccgatatcatgacacagtgtacggatatacgttccctttgaacaggtcacttccagttttacctccggaagattgatctccaggatccggatctcatgaatcgtgattcttcgtgctttccgctctacttctttgccctctctggcaagctcataaagctttttcccgttaactttgagtgccgaatacatcggcggaatctgatcgtattctccctcaaagctgcggatcacattttccactttttcattggtcagatcttctgtgctatgtttttccagaacctgaccggaagtatcctgtgtatccgtcacctgaccgagaagaagaaccgcctgataggttttatctttatctgtcagcaggtcacaaagctttgttgctttcccaaagcagaccggaagtactccttcggcatccggatcaagggttccggtatgcccgatctttttctgctttacgatcccacgcagctttgcaaccacatcatgggacgtatagcctttttctttatatacattcagcacgccatgtatcattccgcttcgctcccactgttaaactgaagttccagtcttcttgccagattgttgatgatatcatgtggtgtggcagtcatggagaatccggctgcccttgcgtgtccgccgccgccaaaatagcttgcaactacacttacatctatcttttcactggatcgcagacttaccttaaaggttccatgttcaagctcatacataaaaattgcaacatcgataccttttgtgagtttcagctggcttacgattccatccagatgtttcgcttttacctggtagaaatccatctcttcttttgtaacgtaagatacaatacatcttccgtccataaaaagaaagctttccaacaatgcacgccccagaatctggttctgtgcataggtcttttcatcaaaagtctctgtaattatttttgtaaaatcgatccctttttccatcagtgctgctgctgcgcgcatggtcgacggatgggtacaggaataacggaacacaccggtatcatgcaccattcctgtgtaaaggcactcggcagtctccacagacatcttcccataatccagcagattgtagatcagctcacttgtcgagcttgcatctggcatgatatagttctgatctgcaaaactctggttgctcacatgatgatctacacagaatcttactgccgcttttttgaaaaggactgccgaaaatccaagtcttcccatatccccgcaatccagtgcgataaacagatcataggttttttcttccgtcacttcatgccggatcttatctgtatttttcatgaacttcagtgtattcggaagctcttccagataaacatcgatctctttttcaggaaaattctctctgacatagttatacaatcccatgcaggaacctgcacagtccccatccgggcggacatgtccgccaagtgcgatcgtcccggctttagaaattgcatctaataacatactaatcatcctcttcccgtaaatctcttgttacatcatcaattttctttgacatccggacaccatattcaatggactgatccagtacgaacttgatctccggtgtgttacgcatattcagtgtatgagcaagttcgcggcggatatagccttctgcgctctgtaatcccttcagggtatcagcctgggctttttcatcgcccaggacactgatatatgctttgcaggttttaagatccggagcaacctctaccgctacaaccgaagtcatcggtgcaacacgcggatccttgatccctccacgcagaatagtactcagttcacgctgtacctctgcatttactcttgtattcttaatgctgttttttctcattatctacccttctttatctaggaacttccaccatcttgaatgcttctacctggtctccttctttgacatcgttgaaacgttcaaatacgaaaccacattcatatccggctttaacttccttcacatcatctttgaaacgctttaatgaagcaagctttccatcatagatcacaacgccgtcacgaacgattcttgcctggcagtcacgttcaaatgtaccgtcaaggacataagatcctgcaattgttccgactccggaagccttgaatgtctgacgtacttcggcatggccaagtaccttttcttcaaatacaggctcaagcatacccttcatggctgcttcaacgtcttcgatcgcattgtagatgacacggtacagtctcacatcaacgccttcacgttctgccgtttcctttgcagttgcgtccggacgtacattgaatccgataatgatcgcattggatgctgctgcaagcgtaacgtcagattcattgatcgcaccaacaccaccatggatgatcttgacaacgacttcttcattggaaagtttgacaaggctctgcttgatcgcttctacagatccctgtacgtctgcttttacaacgattccaagttcttttaagttgccttcctggatctggttgaacagatcatccagagacatcttggacttggtttcttccagtttcttgatcttgttctgactgatgaacgtctctgcaaagcttcttgcatctttatcattcttgcagccaacaaatacttcacctgcattcggcacatcattaagaccgaggatctcaaccggcatagaaggacctgcttcttttacacggcgtccctggtcatccatcatggcacgtactttaccatatgcagaacctgctgcgatcggatctccgacacggagtgtacccttctgtacaagaacggttgcaaccggtccttttcctttgtcaagctcagcctcaattacaagacctcttgcgcggcggttcggatttgctttcagttccatcacttctgcggtaagaagaaccatttccagaagctctttgattccttctcctgtatgagcagataccggtacacagatggtgcttccgccccagtcttccggaatcagttcatattcggtcagttcctgttttacacggtcgatattggcacttggcttgtcgatcttgttgatcgcaactacgatctcgatccctgctgcctttgcatggttgatcgcttctacagtctgcggcatgacaccgtcatctgctgcaacaaccaggattgcaatatcggtagaatttgcaccacgcatacgcattgcggtaaatgcttcatgtcccggtgtatcgaggaaggtgattttctcaccgttgatttccacaactgaagcaccgatatgctgtgtgattccacctgcttctcctgcgatgacatgggtatcacggatcttgtcaagaagagaggttttaccgtggtcaacgtgtcccataacgcagactaccggcggacgtttcttcattttcttttcgtcttcttcgtcttctttcagaagttcttcgatcacatcgactacttcttctttttcacagagcacatcgaattccagagcgatttcttcagctgtctcgtaatcaatttcctggttgactgttacaatcttgccctgcatgaagagtttcttaacgattacagatggctggatcttcattgcatctgcaagttcctggattgtaagtacttccggaattgtgatctgcttgatctgctcctccacaacctctttcttcggctgtggttttaccattttcggctgagcgttattgtttttgccctttttgcctttctgcagtctgtcttcgttctcttcatttctgttatattctttcttcttgtgcgcatcttttggtttgttgcggcttggtttctgttctgcgattgcaggtgccggaatagacgggctggattttcttctgtcgtcacggcgtccgcaatcacgcatctctcttccgtctctgttatcacggttatctcttctgtctccgcggttctggaatccgccatctcttcttccatcacccgggcgtccctgtctctgatcctgaccgtttcttggtccgtttggatttctgcgctgtctgtttccgttctgcggacgtccctggccatttccctgagggcgtccctggctgttaccattctgtgggcgttcctgtctgtttccattgccctgtgggcgtccctgaccatttccattgccttgcgagcgctgtccgtttcgactgccctgctggcgtccctgaccattacggcctcttccgccgccctgtgagttctgcggtctgaaaacctgaacgatatttttcttcttcggggtatcttcagaagctttttcactttttactgcatcaatctgttcatctgaaagtgtactcatatgacttgccacctcaattcctttatcttttaatatagagagtatttctttgtttgtcttattcatctgttctgccagttcatatactcttaattttgccataaatctacctcctgtatacagttcctattatctttcttccatatccagatgttttctgattccttttgcaaaccctgcatctgttactgcaagcgaagcgcggaactcttttcccatcgcatggcccagggtatctttatcttcaaaaaagtatattggcactttataaaaatcacacatgttctgaaatttcttttttgtattgtccgatgcgtcgtctgccacaatcaccagatgcgcgcgtccttccttgacttctttttctgtcatgaattccccgctctttgtcttgccggctttggtcgccagactgatcatcgataatgctctattcatgttcaagctgctccagctccttttccagattttcgtatatctcttttggtatcgcctgtttgaaagaacgttccagtcctttattctttattgcttcctgcaaacattttccggaaaagcacagatatgccccgcgcccgttcttacgtccggttgcgtccagaatgaattcgccttctgctgttttcagaacacgcagcatttcttttttattcttcatttcctgacatcccacgcatttacgcatcgggatctttttggtcgtactcaaataatcacctctgtctattcttcatacagatcaagatcatctgctacttcttcctctgattcttcatcagcagaatattcttcgtctgaatactcttcctcctgataatcatcttcataattctcagccatattcatataatctgccggaagttcgccagactcgatcgcctgtgtttcgttcttgatatcgatcttatatccggtcagtcttgctgcaagacgtgcattctgaccttctttaccgattgcaagtgaaagctggtaatccggtacaattacacttgctgttctctcatccggatcagccattacagaaataaccttcgccgggctgagtgcattctcgatcaggattgccgggttatcactccagttgatgatatcaatcttttcaccgcggagttcatttacaacggctccgactctggcaccgttcataccaacgcatgctccaaccggatctacatccgggtcgttagaccatactgcgatcttggtacgggaacctgcttctcttgcaatgctcttgatctctacaataccatcacgcacctcggttacttccgcctcaaaaagacgcttaaccagttccggatgtgttcttgatacaaggatctttggtccttttgtcgtgttcttcacctctacaacgtaaagtttgatacgctctgtcggctcgaatttctcaccttttacctgctcattctcagtaaggatcgcatctgcttttccaaggtttacactgacattcttgccaatatatctctgaaccacacctgtcacgatatctttttctttttcaaagtactgatcatatacaacttttctttcttcttcgcggatcttctgaagaatcaggttctttgcattctgtgttgcgatacgtccgaaagatttggactcaaccgggatctgtacgatgtcaccgacctcataagaaggatcgatcatcttcgcatctgcaagactgatctgttctactttgtcctctacttcttctacaacggtcttctcctggatcagagtgtaatcgcatgtctccttatccataattactttgatattgtctgcttttccgaaatgattcttacatgcattgatcagtgaattctcaatggcatccatcagagtatctctgctgatatctttttcctcttcaagaattgtaagtgcttctaataattcggtattcatttccttcttcctcctgtcactagaaatcgaacgccagacggatcagtgcgatgtctgctttatcaaatgtcatcgtctcgccgtcttcatattcaatggtaactgtatctttatcataatcttttaagattccaataaactctttctgtctgtcgattgcccggtaagtacgaacctctacttcttctcccaggcttcttgcaaagtctttttctttcttcagcggtctgccaagtcccggcgaactcacttccagaatatacgcttcatcgataaaatccttctcatccagaatgtctgaaagttcccggcttacaacctcacagtcatcgaccataattcctcccggcttatcaatataagcacgcaggtaccagtttccgccctcttttacatattctacatcccagagatcaaatccatgcttttccacgattgggttcagaatctcttctgttttctgttcatatacttctttttttgacaatctgcaacttcctttcttaatcaggctccaaaaatctgtccgattttggttgtatgactggcaaaaagaagagtgaactttcgtccactcttctgccagatttcttatgtaactgcatacagtatagcactacttttcctgaaatgcaaggatttttaaaatatatgcctgattctctttgtaaagacgctttccgtcgttctccttcagccattttacaacctggatatttgctgcccagtcatctgcccagacttcatcaccttcgccacgcgccgccgctttttctgcgatgtatcccgccgggtcttccgtaagatctttcagtacttcatatgctttttcgttcttatcatccagatcctgtatcaaaacaacagtttctgtatccggtgtctttccatcgagtgcctgcagctgttcattatatttttccagattctccaggctgtccttcgcatcctccagacattctgtcaggatttcgatctccgtttttccagtaccaccctttgcaaccgggcggatggatatttctgaatcagcagtcgtctttttcagctctgcccgaattctctcctcatcgtgatccattcttccgatatcatatccaaagtaaaaaccgccaattccaatcacaacaagaagaacgattgcaaaaattctttttccggattttttctttttcatcttccgtcctccttaccctaatatcgtacctgctataattccaaggatcattccgccgatcccggttcccgcaagcgccgcaagatataagagtaccttcaccgctttggatttctcctttttcacctttggaagtgccggaccaggctccggtgttcgcctctcctgcgtctgttccggtgtctcctgccgcggcattctttcgatttcttcttgtgtcggataggcaaacggcatcacatctgcttcaagagctgaaaataattttccatcaatccactgaaaatactgccagatcgccgcatcaaacatccggtgggtatccagaaaatgataccaggattccacaaaggtttttgttcggaaatattctctatacgccggttcctccagaatatccttccagtgatacagcttattccgttccttttcattcaaatacaaactgatgcactgctccatgattttccggacctcacggtcatccgcgccttgtcgctcagaagcatccgccatattctggaactgacgggtccagtcaccgtcccacgcttctgagtcgtccttcggttgctcaggaggttctactgactgtgtagcactctcctctgacttctcatctttctcccgagaattttccatgcgatcttctccggattcttcttccatccgccgcggctcttcaggcatctgtgactcctcctctcttcccgcattgcgctccgcccacgcaagcgcctcttcataggcatcgtggatcctctggaattcctccgggtattcttccgggtggaactcccgggacttcgccgcatacgcccgctttatcgttttcttttccgttgttggttcaatcccaagtaccgtaaaacaattcatcactgctgcctcctccactcatcatacagataagcttctatcttgaccggcaccgatctcttcggtgtattctccacaatatccagaagctcacttgcccttgtatacgccttctcgatcgtccgcagatcctgtgcatttaatgcaactgaaaaatctgccaggatcttgtccagatattttcggatttctccggtgttttcttcgtaaagacggtcgcctctttccagcagaagccggttcttttcctgctctctcggatggatcttaatcttctgcagctcttttcttctttcctcaatctgctctggtgtcagatggatatctttgttgacgatcaccttactgaaatgctccttggtgctcaccacggtcacatccacttccagaattccgttaatgtcataggtaaatcggacatccaccgcttccctctgatcctctcttcttgccagcggcaccggcacacggatccgcccgagctccagattctggtctgcatatcggtgctcgccctgtaaaatcgtgatatcacagtattcctggaactgatgtaccgtccagtatcgctccacccggctgatcggaagaaccgaatttcgctcaatgatcggagacatgatcgccggtcctttcggatccccgtgaatgatctcggttccgagtgtaaacggacatatatctgtaagaagtacatcccgcactgcctgctgccgctccttaatcccggcatacattccggcgccgaccgcaaccgcaacatccggatcgatctcacatcgcggtcttttgccgctcaaaaactgcagataattctgcacgatcttcatcttaccggatccaccgatcataatgatctcgtcaatatcctcccatccataaccactgtcgttcatcgcccgtttcagcggaatcccgattccttccagcagttttgcagacacctccagaagtcctttcgcatccagtttcatctggtaaatctgtccgccgatcacaacctccatctcgccctccggcgcatcagtcagtgtacgtttcagcttctcactctcccggatcaggctggctctttcttcattagtgatctttccttcatcaatccgattgacacttagaaatttttccgcaattgcacggttcacatcatccccaccgagatgattgtctccggcaactgccacaatctcgatcacactgtcaaatgcatctacgaccgagatatccagagttcctccgccaaaatcaaacaccagaaaggtctgatcctccttagtctttccaaagcgataggcaagtgctgccgccgacggctcattgaccagacgctccacagtaagtccggcaagctctcctgccatcttcgtcgcatttctctgaaaatcattaaaatacgccgggacactgatgactgcctcttcaaccggctcacccaggtatttttccgcatcttctttcagctgccgcaggaccatggacgacagatctgccgctgtaaaccgcctgtttccaagcataaatgtcttctccgtccccataaaacgtttgaaacttgctactgtactttccggatgggagatcagacgctctttcgccgttctccctaccagcatctcaccgttctcatcaattcctactaccgacggtgttaaatattctcccagattatttggaatcaacgtgcatttatcatcctgccacacgcttaccagactgtttgttgttccaagatcaattcctaccgttgccatatgaccgacctactttctcattcgtgttcctgttccatctcttttcgcccgtttcaagcggttcagtgtcacttctttttcatggaagatcaccttgctctccgttccttcttcaaacagatatacctcttccacactgtcatttttctgtaatttcataccgcgcacaccaactgcaccctttttcttctccgaaacttcttccgccgggaaacggagcacaaatccattctccgtcatcagaactacatcctgcacatcccggatcggccggatacttaccagtgcatcttcatcctgcagtttcgttgccgcgattgtccgcttagttacctggaattcacttcctgccacctttttgatcattccctgcttcgtgacaaacaggaattttgagaaaaagagttctctgtcatcacacagatatacgatttcttcttttgtactgtcaaaattacttacattgtcgattggaaatcctttgtccctgaactttccataagggagatccatcactttgatctgatgcatcttgccatccgatgtaaaaagacacaacttgccggtattcatgcagcgcagaatatacttattctccttatctgccgcttcccggttacgttcatagacggatccatccaccgtctttgcataaccaaagcggtccatcagaaggacaacctcctgctcctgtactttattttcctcaaacacagcttcttctgcattctcgatcttcgttttacgcttcacggcatattcttttttcagcgcatccagatcatcaatgatcacctgcgccatagaatcataattattcagaatatcctcatattttgcgatatttgcaagcgttgtctcatgctccttcatcagcgcctcgatttccagaccgatcagcttgtacagacgcatctccagaattgcctgtgcctgccggtcggtaaaccggagcatggatgccatcttctcagatcttttcgacttaaacttgatcttctctgtcgcacctgttgtcagacattcttttgcatccctgatggacgagcttccacgcaggatctcaatgatcaggtcgatcacgtcacacgccttgatcagaccctcctggatttcttttttatcctgctcttttttcagcagcgtcttgtattttctggttgcaagttcaaactggaaatctacatgatgttcgatgatacgtttgagtcccagtacttccggtctgccatcggctaccgcaagcatattgacaccaaaggtatcctccagtctggtctttttataaagcatgttgatcagattgtccacatctgcatcacgcttcacttcaattacaatacggattccttccttggaagactgattggaaatgtctacgatgtcactggtcttctttgtctccaccagattgcagacatcgttcagaaatttaccgattccggctccgatcatggtgtacgggatttcggaaatgacgatcttcttccgtccgccttttatctcttccacatctacttttccacgaatcttgatctttccggttccagtctcataaatttctgccagatcatctttattgacgacaatcccgcctgtcgggaaatccggtcctttgatgtacttcatcagctgttttgtcgtgatgtcattgttcttcatgtatgccttaaccgcatccacaatctctcccaggttatgtgtcggaatactggttgccataccaactgcgatcccttccgcaccgttcagcagaaggttcggaattcttaccggaagaactgccggctctttttctgtctcatcaaaattcggtacaaaatcaatgatatctttgtccagatcggcaagatatgcctcctgtgtgattttcgccagtcttgcttcagtataacgcatggctgcagccccgtctccttcaatggagccgaagtttccatgaccatctaccaggatcattccttttttgaattcctgtgccataacaaccaacgcttcatagatcgagctgtctccatgtggatgatatttacccatggtatccccgacaatacgcgcacatttacggtatggtctgtcataacggattcccagctcatacatgtcatagagtgttcttctctgtaccggtttcaaaccatccctgacatccgggagggctctggaaatgataacactcatggcatagtcaatatatgattttttcatcagctccgaatattccgtccggatgatctgtgactcttccattttctcttacctcttctagttcatgttttctgatacacagactttccccttttgaaaatccatgcctttccgatctgtttttaaatatccagttctgcctctgtcgcattttcataaataaatgcgcggcgcggcggaacttctgttcccatcagcatctctgttacaccggatgccatacgtgcatcctcgatctcgatccgtttcatcattcgagtttccgggttgagggttgtctcccagagctgctctgcatccatttcacccagacctttgtatcgctgcagggtaaagtcggaatgtgtctttctatatctctccagtgccttatcatcgtaaaggtactcttcttctccctttttcggcattgccttataaagcggcggcattgccacgtagacatgaccttcgtatatcagttccggcataaaccggtagaataaggtcagcaacagtgtggaaatatgcgctccatccacatccgcatccgccatgatgataatcttgtcataccgcagctttgtgatatcaaagtcattaccgtatccctctgaaaatccacatccgaatgcattgatcatggtcttgatctcagcatttgccagaaccttatcgatgcttgctttttccacgttcaggatctttcctcggatcggcaggattgcctgatacattctgtcgcgggcagtctttgcgcttcctcccgcagaatctccctcaacgatgaagatttcacatttggatgcatccctgctctcacaattggcaagcttaccgttactgtcaaaagaatatttctgcctggtcagaagattcgtctttgccttttcctcggtcttacggatctttgctgctttttccgcacaggaaagaacctttttcagtgtctccagattccggtcaaagaaacgcgggatctcatcactggtcacctttccggtcgcttttgctgcatcctggttgtccagctttgtcttggtctgtccctcaaatctcggatccgggtgcttgatcgatacgatcgccgtcattccgttccgtacatccgcaccggtaaagttggcatccttatcctttaacacaccaatttcacgggcatactggttcatgatcgtcgtaaatgtcgtcttgaacccggtcagatgggttcccccttccgcattataaatattgttgcagaaacctagtacattttcatgaaattcattcacatactggaatgcaacttccacttcgataccttctgcttctcctttatagtaaaccggatcgtggatcacttcttttttggaattcagatccttgataaatccaatgatcccatccggttcatgatactcgatcctctcttcctgtgtctttcttttatctgtaaatataatcgtcagttccggattcaggtaggctgtctcatgcagtcggctcttgatctcttcctctttaaatctcgtcttctcgaaaattgtcggatccggaagaaaattgacacaggttccggtctttttggtctttccgatcaccggaagaagcccatcctccagttctaccaccggaattcctctctcataacggtcgtggtggaccgcaccgtcacggctgatctttacatccatataagtagatagtgcattaacaaccgaagaacctactccgtgcagaccgccacttgtcttgtatgccgaatcatcgaacttacctcccgcatgtagggtggtatatacgattctggccgccgatactccttttgcatgcatacctaccggcacaccgcgtccattatctgttaccgttgcagaaccgtccttttccagtgtcacctctatctgtgaacaaaatcctgccagatgctcatctaccgcattatctacaatttcgtacaccaggtggttaagccccttggtactgacgcttccaatatacattcccggtcttttccggacggcttccagtccttccagaatggtaatactctccgcgtcatatgtagtcttttttgccattttctttctctcctcttatgatctatcctaaaatatccaggtaaaatcctgcggcagcagcctccttacaatttcccggattccctgatctgtttcttcaattcagtaagaaaaattctatctcaatttcaatcctcttgtcaagccaaattgacctctcctgccattataacatattttatatcgttaaacttctgtagtttccattctgtcataagaatactccctctatcgtccggtcagcacactatttaaaaggtctgccagcacctccatggcatttcgcatttcctctaccgtgttggtctgcgcgcccgcctcaataagaagcatccgcggcatcagatccatattgtatttatagccgcgaagatagtttctccttgcaaatcccggatattttgtttctgccgcaatcttcatctgcagggaaaatgcaagattatcctgcaaatatggattggccattccggcaaggtctccgtttacccgcgtccggctcagtccgttaaaaaacatgatctgtgccgtcggtttcccatttatctctgtcaccagatgcgtagtatccgccacgccgtctctatgcagatcgatcaccacttcgatactcggattttccgcaaggatctgttccacctcaggtttggcaaattcataggcctcgctccggtccagtttcccattgatcagatcatatacaccctcatgatgcatggtcggaatcttgtatttgttatttaaaatctccgtcagataacgcccgatccctacaattgaggtggacggatcattgtccgaatctgcgaatgtctcctgggaatgggtgtgatagatcaggattttcgaaccgcccgtactcagatcgatcctcaaatcctttccaagcagctccgaagcgttcaactccgaaggattgatataagtcacgctgtccaccgtataaaaattgctcacaagatattcaaaatcatttagccgctccatcgaaagatccatcgtcggtacggatgcctgccttgtctcttcacttttgtcttttccgataagctgtccattttcatccaccgaattttcttcttctgcctgcttttttgcaagaatcgcataggtagcctcatcttctgtcagaagctctgccgcctcccgttcagtcacataattgccaagaggaatcagggcagatgccatgtggacaacagcctccgtcacccggattttcccttgttttttttccgtatatgtaactcccggcatataaagccgctccgcattctcctgaacgctctggatcatcctgatcttccaggacttcgggatcagcgaaccgctgctttttgcttccagtccccagattcccaaaatcataatggcaagaagcacacaaattctctgttcttttttcatctgcgcgcctccctgccagtttctgaagatcgctgtagcaaaaccatatctttccagactggatcctgcccctgaccttttgtgtcatattgacataatatatgcagctcactgcctgattatgtcgctgaagctgcaaaaagcatattcagtgcctccgaaatcgtataactgattcgcctgacggtctcatcaatatcttttggtgttacaaacattccatttaaatgtggcgcgatcagttctttgatcagctcatatttttctgccggactgtatcctttgatcacacttgccatgccttttaaagattcagatacttccactgcactgagcagattatccatcgtatcgcctacaatggttgccgcatccactacagtcggcacaccgattgcaatcaccgggatcccgactgtcttttccgtgattgcatttcggtgatttcccaccccggatcccggattgattcccgtatccgcaatctggatcgtccggttcagcctttttgaatttctcgctgccaacgcatcgatcaccagaaggatatccggttttgtctctgccaccaccccccggatcacctccacagtctccattccggtctgccccataacccccggcacgatcgcgctgaccgaccaaacctcatcttcccctgttgcatactttccgtactcctcaatgatatgccttgtgatatgcaggttgtctaccacataaggaccaagtgcatccggtgtcacctgccggttgccaagaccgaccaccaggatcttttccatctttcttttaggaagtagttctccaatgaatttccggagctgctgtgaaatctcctcatgatatccctcatcgggaactgccatttccggtgcctcgatcgtgatatagctgccaaccggtttccccatcacttttgctccgttttcggtctcaatcctcacggtcgtgatgcggatctcattttcctcatcatactcttccgtcaagatcacaccctggacctcaacatggtcagattcaaaccgttccttctcttccagcgccagatccgtcctgatattatacttttcaaccatagtcctctcccatttctgtattttctgtcttattcacttagtttttcgcaaaaaattggaattatgtattgacaagcaatctttcttcgcctaaaataaataagtgtgttcgacggatgttccgtgtcacttttcgtcgaattcaatattatgattatataatttatgaaatgataatttggaggtgtcggaaatggctaatattaaatccgcaaaaaagagaattttagtaactgagacaaagacagctagaaataaagcaatcaaatctaaagtgaaaacttatgtaaagaaagttgaaactgctgttgaaaagaaagacgttgaagctgcaaaggttgcattaaaagaagcaatctctgtaatcaacaaagcaggaagcaagggtgtttaccacaaaaatacttgcgcaagaaagatctctcgtttaacaaaagctgttaacgaaattgcttaattccggtttcgagataaataatgaatgataaaaaggcagccatcccgtcagtggctgtcttttttgttttcataaatctttcaaaaaagagtctgtactgaaatgctgcttgtattcggtacagactttttttgtcttatgattttctcttataatttagaataaccgtagctgttcacaatagcttcgatccgctgtccttctctgcacttcgggcaatcttccggagaatatgctctgtaatgcggaagatcactgcttgtgaagatcgtattgacttccattcctgcaatcttgttgactgaactgaaaattgcgctgattccgcagactcttccaccgtagtagagaacagactcgattgcttgtttgacagatttaccggttgtgatggacgctgcaaggatcagaacctgtttgttctcaaccattctctgtttgttatcacggaacaggatctgtccgtcctgatacatctccggggtaataatggaaatgttgtttcctttgctgagtgagtactggttctcatcggcaagctgctcggcaaggaaggttccgatcacttctgtctcttccatgcaaacgatggtatctaccgttgtgttagaaaggtaagctgctgcaagaacttttgcagtttcacgggcattgttgtgacgggatttgaccgttgacatgtcgatgtaggtgttgatgtgggaatgacttgttgcaaagtgtccttttaaaattttaattcgcgcctttgggtttttagcggagcgaaggtcttccagtctttcatccatttctagttcctcctttaagttgttttggtggttttgactggttttagtatagcacagagggatggattgtgcaatatgtatatttcgtgaggttttgaaaaggaaacaagttaaaaatttttctaatctattctccgtaccaacttagttgtgcattccatagtttttgataaagtgaatctgaatttgctaacaattcttcatgttttccctgctctgctattgtaccatgatccagcaccagtacccggtcagccatttttgcaatactaagacgatgtgaaataatgataagcgtactgtcatttcctatacgtctgaaaataagatcatttaattctttttcatatagcggatcaatggctgatgtaggttcgtccaataaaaagaaagtccctccgtggtaaaatgctctcgccatcgccaatttctgccattgccctcccgacaaatctacttttccaaactcccgtccaagaatttcattttttgcaatctgactgaggtttagttctgtaagaagctcttctgcaagtactggattttttaattccaattcctggggagcaagattttccagcaacgttaatgcatattgctgatattcctgaaacataacagaaggtgtatcagcgagaacaccttcatttttcccttctgtaactaccagtaatcctgccagtaatttagaaagcgttgttttcccagcaccattcacccccactatagcgattttctctccggcatgtattgcaaaattcaaatcatgaagcaccggttcttttcccgtcgggtatgtaaatcctgcatgatggaatgcaattttacccgttgatgcgattctttgtgtttcgttctctgtatccagaaacaggaaaaatggttttaccattagacaaaactgcgaaaaagctcccaagtctgaaaacaactgtgcatactgattctgaagctgaaatgttgcagaaactgctaccatgaacgctggataatcaatttttctctggaaaaacaaatagccggccagtacatagacacctgctgttgcagcaacatttaaaaacatcaaaaaagtacgaatctttaacacctgcatttccacttcatattctttttcacgcagttttctggaagaagttttccatttctgaataagaaaatcactgctttcatatacaatccgctcttttgtgtagcggatatcagttgtacattcttttcggtccttttcttcttttgcaagagccgctaattgtgtacgcctgcgactttttaaaattgcttcactgacatttccaaaaagtgctggaatggcagccagtacaataagaagagaaaaagacgaatggataatagatgcatatccagaaagaagaacaattgacagcaccgcaccagataaagtaatcacgcattcgactacccgatatacattgatacttgcaactttcgcttcccatagtctgttatagaaggacggcatctcataataacgcatcgcaatttttccacatttttcatgaagtatcaattttgttttcttctcaaattccagcaatcctccgaactgaacaatcacacgctcatagtaaatggtgtagcttttcatcagaaacaaatacgctccatagagcaaaaccggaagaagcaatgttaatacctgatagtctgacaatacagacttttcggcaagctgatagattcggcgactgatctgaatgccaaatactggaagtacagccagaaataggtggacgaatatcatccctgcaaaatgttttggcatcatttctgcacccagtttgagacatttcgccacaaccgtatgcttacagttaaatttcatccacatacatctccttctgtgtttgataaagttttcgataaactccatttttgcgcatcagttcttcatgacacccatgctctaccaactgaccatgatccaatacaagaatttcatccatctgactgacagcgccgagacggtgcgtgataaataacgttgtcttttcttgaaatatatgttcactcaatctatatacttcccgttcagaaataggatcaagactggctgtcggttcatccaaaagaatgaaatctgcctccgaaagaaaagctctggcaattgccagtctttgcaattgtccttttgaaagtaatgttccttcttctgtcaaaagtgtaagtggtgtgtcaagcccctgcttcagatttgaacattctagcatgtccagtacctctgacactctggcattcgaaagattcgaatcatttcccatcaaaagatattcccttacagttaccggataaacctgaaaatcctgaaatagcgctgtctttttctcagttccatcatagattctgccatttgtcggtttataaagatcaagcaacagttttgcaagtgtcgtcttcccagccccatttactccaacaagaccatagtgttttcccttttcaaaagtaaagcagatccctttcaaagtatcttcattattttcataataacgaaactgtaaattgtccaaagacaatacattttctctgggtgattctgccctgaagttattcgctgaccctttttccaaaaaatcattttctacaaatcggattaattctgtgcgaagaccatgaaactcccgaattggaaatacgctttctgcacaccgtgaaagttcctctagcattcttgcaatggtttccgtgattgcggtataagttccgagtgtaatcgactccattgtattcggcaaagcaaaataaaacattacaaaaactgtaattcctatcaaaatactctcgagcaatatttgtccacgaaaccgagtatgaccactctttcgatttatcctggcagcctgatcaaattcttttgaaaatcgttcatccatagccttcgatgtgtcataaatccggcgctcataagcatattcccgtttaatttgtaaatcagaaagataattaaaccgacgtgctgtctccatatatcgtttccaaaaaccaaaggtattttttgttgtccgtaaattaatcacaaaagcaactaaaacgagtatgctcataacaagtattgcgaaaaatgaagtatttctcataaaccagactaaaacgatagaagacaaaacaagtctgagccaactgactaatgcatccgtatattccaatgatttttcaaaatatgaatcggatcgttttattatttcctgtatattttgctgttctaaaaattgaagagaaagtttttgacagacatgcataatcttttccggcattacgtctttatattgttttgtaatccatattttcgcagcctgtttaaatatatgtaagatgttttctagtaaaaacaatataatgatccaaataaaatccattataataattttagaagaagcatcatatacaatatggtcaattaaaaaaagctttaaaaatatctcagacaaaacaacaagatgtattattgtctgtacaaataccattgtaaaataaatacttttattgtactttttttcgtttctcatttcatcgtcctaacaatcaattcctaataagatttccctttccacctcattttttatatcatataagagacttccataaatttcttcagctttcgaaatagtttgttcataaataagttttaagaaattatcttttccaccttgttccaacaacttagtgcaaaatttgcaagcaataaaattagaataatttctatcataactatcataattattccatatttcaaaaatatctatgtcatgcttatttaacatataatgattattatattttacactattaaaacattcagcaactccttcatttataaattttgttttacttttaattctcccttccatattataactactaaatctcataattaatccctctcattatatctttactgaaattcgtaatttacaagataggtgtctttacttgcactaaatatctacattttaatacgctttatatttgcataatttacatagcaccacaatttccagtgcatttgcaagcatctagtggagaaatatgttctgttttatgcagttcactggccatagtttctatttgttgaatcgggttcgttcgtgcatctttaataacttcaaaaatatcatttttttatcatttttcatttcattcacctctccaataaagacacctattatctttactatatcacagatgggataattatcaatatattacttgatacaaggaataatattcagtcttttttgttgttttattattttttgacaaatcaatttaaaatatatcattgaacatttgtgatagaaaacggtttttattttatataatgtaagcgtatcgttttgtaaagagcaatattgtagttttatgtaaaaaatgttaaaaacagtaattcaagcaactttattatagttttacgcctcatttatataatatcactaaaaaatgacagaaaaatctgttttacaactgtcttttataatatcatacaatttcttttgtccattcttcatccactctgctcacagtaatataatcttatttttttcgacttaggtaagtgagatgctggagatgaaaattattggtttgacgggacttttgtttagaggggacgccaaactggcgcgggagcgcggtttggctggatgggtagtttgacgggacttctgttttgggggggacgcggaattggcgcatagcgcgattccgctgggtgtgtttgtgagtttgtgggtcgaatgatttacatacaagccggtcagagtctcacaagcagagcttgttcgaccgttggcggcgccaactaactaatcagaaatagaaggagtcccggaaaagcatgcgagcatgttttggtatgctccccgtcaagaggacaataaaaaataataaatttttgtatcgtcagccatgctatggctggcgatattttatgctgcttttgtatattgctcatgatatttcattggtgtcattacatgcagtttcctttgaagtcgttggttgttgtagtaatctatgtaattagctatcgcagtaatcaaagagcttctgtcattaaaacgctgtttataatacatttctcgttttagaattccccaaaacccttccattggtccattgtcaatacagtgggcaactctagacatactctgcttcatatgatgtttttttaatctagtataaaactgtgcgcttgtatattgaaagcctcgatcagaatgaactaatgggtgtgcatctggctcctgacgaacagcctcatcaaacgtgtccataactaatggattatcattatgatcgctgattttaaaggaaacaatccttctatcatataaatctaaaatagcactcagataaactttatgaacttctattccgttgtagtatttaaattcagaaacatctgtaagccacttttcattcggtttttcggcgtgaaattcacggtgtaaatagttttttgctatgtgatcaggatttctgtctcctctggtacaactcttaggtttccatttaatatttgattttatatcgtatttcctacaaatacgaagtactcgtttatcattcacatgaattcctttatgtccatctaattcatcacgaatcctccggtatcccatatctggatgctggtgatgaatcctttggatttcagtggatagtctttcgtttcgaagttcattattacttttcggatattttccccagcggtaatacgcagaacgtgtaacattaagatatttacaaagtctatctatgggataatgcttagtagacgatagtttttggatggcttcatattcggctaaccgatggattaaagatagcgacccctcctttccagttctctgactttttttaacagatcattctccatttgtaggtctagatttcttctttccagttcagctatcttgtcacgtagctcttcttcaggtgttctgcttggaagagaagctatacgacgtccacgtctgtcttccagacccgcttgacccatcttttcgtatcgtattacccaattgcgaacttgttgataggaacaatcatatttgagtgccattgcaccataattcttatcatttgcaagacaatctgttactatttttaatctctcatcaagtgtagtgttctttgcctttttcatgtaagcacctccagtggatgtttttaatattccaccagaattatacaccttaatccaatcggaaagctgtctgtgtgaacgaattccgtattttgtgcaaatatcctgaagagatccttctccgttaagataatcatttatagcagatatttttaaatcttttgaataagatttgtttttcggttgattgagtaatccagttggtccatcatactgataaatagaaacccaatttcgaatactatgatgatcaactcccaattcttttcctgcttgctgtatgccaatttctcctgcaaggtagcgttcgactatttttactttttctactggttctatcttactctttctgaacatgaaaatacccccatataggacttttatatttcattgtcctatatgagggtagcatatcatttttccgggactccttctatttccgcttagctgaccggcttgttgcctatcgcttagttattgatcagtttatcttcaccattccagctgtagagttttctgatttcttctcctactacttctgatggatgttctgcggctttctttctcattgctttgaagtgtacctgacgtcctgccggtgacatgtcgagaaggaattcttttgcgaatgttccgtcctggatgtctgagaggatcttcttcattgctttctttgtatcttctgtgatgatctttggtcctgtgatataatcaccgtattctgctgtgttggagattgagtatctcattccggcgaatccgctctggtagatcaggtctacgataagtttcatttcatggatgcattcgaagtatgcgtttcttggatcgtatcctgcttcgcaaagtgtttcgaaacctgtctgcataagggcacatacaccaccgcaaagtacagcctgttctccgaagaggtctgtttctgtctctactctatatgttgtttcaagaagtcctgctcttgctccaccgattgcaagaccgtaagcaagtgctctgtcccaggcttttcctgtgtaatcctgttctactgcgatcagacatggtgttccttttcctgcctgatattcgcttcttactgtatgtcctggtgcttttggagcgatcattgttacatctacgtatgccggaggtgtgatgcatccgaagtggatgttgaatccgtgtgcgaacatcagcatgttaccttcctcaaggtttggttcgatgtctttcttatacatatcagcctgaagttcatcgttgataaggatcatgatgatatcagctttctttgcagcttctgctgctgtatatacttcaaatccctgagcttctgcttttgcccatgatttgcttccttcgtagagaccgataatgacattgcatcctgaatctttcaggttcagtgcatgtgcatgtccctggctaccatatccgatgatagcgattgtctgtccttctaatactgataaattacagtcttcctgataaaaaattcttgctgccattttttatttcctcctatgacttattgaattctatagagttaaaggctccatgcccctagctttcttaggtaactactgctgcatccctgaaggtgccactttcgagctcgtcgctcttttcaaaacgtctctctgctttaatcaaacatgatcacatcatcgcttccgcgcttcagtccggtaataccagttcttgccagctccaggatctcatatccgtccagaagctccataaacgctttcagctttgattcggttcccgtcagttcaatcatcagacagtctttttcaacatcaacgatcttcgcacggaaaatatctgccagtgaaataagttctgctctttcagatgcatttgcacgaaccttgatcataaccagttctctgcatactgaattgctgtcatttaacggcttaatctcgatcacatcttccatcttgcgaacctgcttctcgatctgtgaaagaatctgttcatctccacttgctacgatcgtgatccttgtaaatctcggatctgcagttgtacctgcggtaatactttcaatattgtacccccgtctgctgaacaatcctgccatacggcttaatagtcccggattgttataaaccaaaattgaataagcttgttttctcataacatactcctttactttacaaaacagagtgcgttctgtttttttattgtagcaattgacaccacctttgtcaagtagctttctaaaattttatcactttaattcgattttatcaattacaggaacctctaattatcgttttcacactgatttttccgaattttgtcaaaatatatccttttatcatctggacatataattcttcaattgcctgccggacaaatcgttttttgtcaaattcgactgttgtcagctgcgggcggcaaatgagtgctgtttcttcttttccgactgccatcacttcaatttcctccggcaccttgatttccagatcatgcagataaccgacagcctctgctccctgtacggcagatgcaaatacgagcatatctgcggataaagcaagccctgccagccggattttatagaacattctccgcagatccctgtcttttggaatttccagatattgttcttcttcaagacagtagcctttttttgaaaatattttctgcattccctgccataccacttttccgtactcttccgttccatccagaaaccagattctctgtttctctcttttaaacagaaaccttgcgacttcctcaccggcttttccgtaaatccggtctgttctgtatatcgcagccaccggaactgcacacatctgtcggattcttgtacacgcctcttcattgagccagatacagataaccccatccagtttccataccgccgcatatcgtacaaattcttctgctgtttttacaaaatgcagcaacatatagtattccctctcatccagactcttctcgatctcacgcagtatttcttctaatttttcactctcctgctcccattcctgcctttttccaacaactacagcaatcatcccggaagattttccggaaaggatacgtgctcccatgcttggggcatattcctgttcatccaggatctcctctatcctttttctcgtctttcttgatactttttccgttcttccatggatcacattcgatacagttgttgcactcactccggctatttttgcaatatctttgatcctgattttcccctcagccatttctttcccccatttatttcttttgttttttctgtttctactatcttacacttcttttcttctttcttactaattcgcatttttccgacatcacctgtaacttttcgataaaatattttacagatcattgcccggatatccaccttgtgctatccttaatctgttaaataatttttcagatacaggagattgaatcatggatggtattatatttgacgtagacggcacactctgggactcaaccgaagcagttgccagatcctggaatcaggcgatagaggagaatacagatttttccctctcacttacagcagattggcttaagtcactttttggaaaaacaatggatgagatcacgcttgcactctttccttcctgcccaaaagaagaacgtgaccgaatcggctatctttgctttaactatgaaaatcggctgcttgaaaccgatcacggtgttctttacccagatgttgcgcagacactggaaaacctttctcagaaaaccgacctttatatcgtcagcaactgccagtgtggatatatcgaagtttttctaaaaacgatgggactcgaaaaatatatcaaagattttttatgctttggtcagacacaggttccaaaaaatgaatccatccgtcttctgatggagcgcaatcatctgcaggatgtggtttatgtcggagatacttcaggtgattttgatgcctgccagaaagcagacgtgccttttatttatgcttcgtatggatttggtgatattccggatccaccaagacagattggcgcaatcagggaacttcctgctcttcttggactgtagattttctctgtttatgttcctggttcaggattatatagcagttttttccatcattcagcatcagcagagtctgccaccgatagtttccttccatacacatgacaatataaaaaaatcagagtctgataatcacatttttatcattctctgatctttttatattgaattctttccagtggatttttccttctctttattccacatcctcttcatcaaattcacacaccacataatacccctgcggtgtctgctttacgtcaatcacctttccctgtcctgacttaagtctctgccatgaacgataattagcgctcattgccacagccggctcaatcgtataataaaaatacgcagctacaacgccctctgtcacatcaacaatctgtccgggttcaaccagtcccggacgctccattttaaattccatctgtctcatttccgcctgatacctgcctctttttctatattgtattcgttttttcttgtaattgcaagtatttacacagactgttttgtgacgaagctttgaagtagaacaccgctgtcaggtggtctttttagccacctgatctaaaacaactgaaatcacattatccttcgttctattcggatttcttacactgtttttcatgcagaacttccggaacgatcatataatgctcctcaatcaattttgctgtcttttcaacaggcaattcttttattccttttaaaaggatctcatgattgtagcgaagtacatcaaaggggatgatggattcaacacccattgtataatatccgcacaaattgctttcccggagcattgcccatattttatataaggtttcgcactttgctgctcgaacaatgcatgaatgaaactgttcatcataacacataatgtggtacacatctttttctttcgcagcttcttccatctggtccagacactcatccatttcccgttcgatttcttccggaagttttccggcaatgatcctgattgccagaacttccagggtagagcggacaagatatttttcctgcatttcttcataggaaatcgtctttactgtactgcctttatgagactcataaacaacaaatccttcctccccaatatgacgcagggcttctctgaccggtccccggcttacatgaaacttctccgcaatatcttcttctacaattcgttcccccggtttgatcttcccccgaatgatgtcttctcttaatacatcagcgatttgctgccaaagagtttttctttgtattgatgccttcctggtataatccattcatttttcctttcagatttttgcagttttttataaaaagaacaggctgatccccacaattactgccagtgtaatggccagagccggccagagtgcccagaatgcccccaaaaccattgccagataatctcccttttcaaaaacaatgttctggtcactcatctgctttttaaattccaggaactttttatcctgttcttccaactgtcttcctcgtttgctgtatcctccaaaaaagctcatgctaattcctttctgattttatgaatccttttctactccgagtggattatgacaggctacaaaatgtcccggtctcatttccacaagttccggtgtaatatgcttacagatttctgtacagtatttacatcttgtatggaacttacatcctttcggcggatgaaccggacttgggatatctccttcaagcgggatcatctctctgttagaatctacgtctgtcgtcggaattgctgataacagcgcttctgtatatggatgtgtagggtgatcaaacatttcctgtgactctgcaagctctacgatgtttccaaggtacataacaccaattcggtcactgatatattttacaacactcaaaccatgtgaaataaataagtatgcaagattgtcttcgcttccgagatctttcagaaggttgacgatctgcgactgaatggaaacgtcaagtgcggaaaccgcctcatcgcagactacgaatcttggtttcaatgcaagtgcacgtgcaataccgattctctgtctctgtccaccggagaactgatgtggataacgatggatcatatatggtgcaagtccacatttttccatgacttccataacatacgcctgcattttttcatcatttttcttaaaaatgccatgtgcaagaagaccttctccgatgatctgtccaactgtcatacgtggattcagtgatgagtatggatcctggaagatcatctgcatatctttacgaaggaaacgcatttcttgtgttttcagtctcgcaagatctactccattatcacggtatgattcgtattttgtaaaagcttcatcatttttatatttgctgcggagttcttctaacttcttctccgctttttcaagttccactttcttctctgcgatttcttttgtcttatcgacaccttccatctggttttcttcatttaaaccgctgatcactctggcaactttgaatttttcaagcagtaactgttctgcttcttttgtgtcatctaagctatagaatccaccaatgatctgaacaagattcaggaattccatattacatttcttctggatattttcacattcggcctgtttctggaatttttccgcagaatcttccattttttcatattccgcttttaatgcttctgccttcgcttctaattcggcaattttctttttaccagaagaaatatttttgattgtttcgtctacataaagcggtgccatatcggtaagagttctgccgtaatacattgtcttaccttctgtctgtttgtagatctgaagtaaagttcttccaaatgttgattttccacatccggattctccaacaagaccaactgtttctccttcgtaaatattcaaagtaattccgtcattggctcttacatactcctgctctttctggaataactttgttttcttaagtggaaaccactgtttcagatccgtgaccttcaaaagcactttcttttcatcattatttggcatggcgtgcctccttatccgggtagaaacaacgaatcaagtgattgtcttctgccaactctaattttggttcttcattcatacatttctctgttgcatatttacaacgcggagcaaatttacatcccttcggaagattgagcggatgaggtactgctcccggaattgcctcaagtcttgctccaaccggtgtatccagacgtggaattgaagtcataagtccttccgtatatggatgtgaacaggttgtctcttttgcaaagatagttcttgctttacacatttccacaacctgaccacaatacataactgccacttcatctgccatctggttgataactccaaggtcatgtgtaatgaacagaatagaggtccctttttcctttttcagttcattcatcagctttaagatctgtgcctgaatggtaacgtccaaagcagtagtcggttcgtcagcgatcagaagacttggttcgcaggcaagagccatggcgatcataactctctgacgcattccacctgacagctgatgcgggaactgtttcataacagattccggattcgggatcttaacagcttttaacatttcaagtgatttctcacttgcttctttttttgtgattttctgatgggttaaataaacttcatttaactgtttttcgatcgtatataccgggttcaaacttgtcatcggttcctggaaaataacggaaatctcatttccacgaatctggtacatatcattgattgtacactccgcaagatttcttcccttgaaagtaattgtaccgctgtcgatatatccgtttccatccaaaagttttaagatactcattgccgatacactctttccacttccggattctcctacgatacctaatgttttcccaggctctactcgataggaaacaccgttgaccgcttttacaattcctttttttgtcttaaaaaatgtatgtagatcatctacttccaataaatatgccatcgttattcctacctttcatttgctttcgggtcaactgctctacgaagtccgtcaccaaacaagttgatacttacagtacaaagtcctaatacaactgacgggaatacccatctccaccagtactgtgagataacttctgaagaacgacagttgttcagcatatttccccatgaaggaattggctctgcaacaccgaatcctaagaatgataatccggattctgtcagcatacaggttgcaaatgagattgttgcctgtacgataatgatcgtcattacgttcggtacgatatgacggaaaataatattcttttcttttacacccagtgcttttgcagcgacaacgaattctttgttacgttctgcaagcacctgtgcacggacaagacctgcgataccggtccatccgaggaaaccgaggatcaacatgatcatgatgattcttccgacatcagatactttatttccgatcaaagcagaaaggatcagtgccagcgggataaacggaagggatccgacaacctctgccagacgcataagaaggatatccacagttccaccgtagtatccggaaataccccctactaagataccgatcgcgaactggatgataacagcgatgaatccgactgtcatagtcatctgtccaccctttaagatacggtagaatacgtttcttccaagattatctgttccaagtaagtaacctttcagtccccatgtcacaacagagccgtcttctttgataatacagttctgataatagccggaagctaattttgcaatattggttgccttagcaggaacctttgcctgattgttttcatttccgccccaggctactgcgtttccatcttctgtcacaacaacaagatggttacgtccacctgaaatatccactgctttgccctgcacttcttccggtacggagaaaatatggttgtgattgtttccccagacttttacagtaccatcttttaatacagctgctgctgctttatctgttaaagcgattttttctacttttccctgaatctcttccggtacattatctaaagcagtttctttctttgcaagcgagatgacttttccatcctttgtaagggcaatggctgtctgaatatttgcttttacttctttgactttttcatcctttacattagctgtagaaatatcaactgcacttgtatttccccatgaaacaacttttccgtcttctgttacaacaacggatacctgatatcctgcttcaatgtcagcaatctttttgcctttcagttccggcggaatcacattaagacccattcggttgaagccccaggtgtataaggtacctttatcgttgattgccagcacgtggtcctgaccaactgcgatatcaacaacttttcccatatcagccggaatttttttcaggtttttcgttaactgtccccactcataaacgtaaccgtctttgtctactcctacaccatatgtcggaccaaattcaatcacttcggcattgtcttttaaatctgacggaaccgaaaggaatgaaaatcccggtgcgatatttttctgtgttggatcctgatagtttaaatcctggtgaaaccagatcggaaggatgaagcacattgcaaaaattgatacaaatacaatcaatcctcccatagccagtttgttttccagcagattttttataatcgtacgaaaaggactttgcatctgttcttcttcaagaacggaacgctgctctttttctttcttctttccaaataacatttgtcttcctcctaatcgagtttaattcttggatcaacgatacagtaacataagtctgtgatcaggtttgcagcaagtcctaacaaaatgtaaaacatctgcatggacagtgcgactgtatagtcatgctggttcaaggaatcgatcagaagttttccgacacctttccatgagaacagagtctcaatgataaccgctccaccaaagatacctacgatagagcctacgatccagcctgtgatcgggatcatcgcgttacggaacgcatgtttgtaaataacagttttttctttcagacctttggcacgggctgttcttacataatccatagataatgcatcaagaagagctcctctgacataacggatcagaccaccgatacctgtcagacatacaataataggaagtgccatatgatataaataatctaagaatgcacggaagcctgtaaaatttgcacccgttgtgaccattccactgattggaaagatcggaattttaattgcaaacaggtagataaagatcagcgccgaaataaatgaaggaatactgataccgatcatagttgctacctggagtgatgtatcaaacaccgtgtctttttttaccgcacatttgattcccagcggaattccgattgcgaaaaggaaaatataatatacaacgttcagggcgattgtatttttcatcggaggtccgatcagttctttaaccggaatacgatatacggtagagtaaccgaaatctccctgtaagatatttcccatccagcttaaatactgaaccggaatcggtttatcaagtccgagacgtactcttgcctgttgataaagcatctcatactgttccggtgaaacactctgcttttgtccctcgaccataagtctggcagggtcaccaggtaccattttgaaaataccaaacagtaagatggaaagcaggaagaatactataataatataaccaagtcttttcaatatgtattttgccataatgtagttttctccttctggatgaaatagttattcctgaattattcatgacatgtgattctgtccgaaccattaccataattttgttttcgtataaagaaaagatacgggaagacagaacattttcctttgttctgtcctccctgttttgtcatgcatatcaaaagttaatagaattgatctattctgatgaatcctttatgcttattcttcaaagtatgcatctaataccattgctccccatcccacatgagctctaggaacgaaattcttaagcttcggattgaagaacatataagaaactcctgatcccattggaagacttggaagttttttgttgtatgccagctggaattctccatataattttctaaatccgtcaatatcttcaggatcaactttctgcatctctttaccgattgcttttaattccggatcggaaatgtagttaacattccagcttcccattaaactcggatcgtcatcgaagcagttccagtagaagagaatttccggaattccgatactactgtagaaaatgttatattctggttcatcgataccctggcgattcaaatggttgatcataagtgcaaagtccatagatgtgtatttatattccataccaatcttttctgcttccggtgggattactgtgttgtaaagttttgagtagtcatcttcacagcatgctacttcaacttttaatttcatcaattcaccatctacttctttataacggtatttgtctgtaccttctttgtactcttcacctttttcgttcagtgtccaaccaccatcgatgagttcctgttttgctttatcaaggtcatatgagtagtgaatcagttcagattcaatatcatctttaattgctgcaaaatctgttgtagcatctgttgcataacagtctaccactgtaccgtatccgcctgttaactgtttgttgatttcatcacggtctacgatataagcgattgcacgtcttacttcttcaaactgtgtcggtccaaagtcacacatataacgcatctcgttgatacgtgttcccggtacaagaccatagtttgcatctaattttccttcttctacttttgttaaagcagcttcgatcttttctcctgtacctgctgagtagaaatcaattgttcctttttcaaattcgtcacggattgtttcatctgcaaccggtttggaaataattgtctggatatgtggttttgttccatcatatgttccaaggtattcttcgttgatttcaagttcaacagtttcagttgtaaggtcaacactctttaatttgtaaggtccgcatacaaccggtgctttgtaacggaatcctttatccggatcaagcaaggtttctctgatgagatcttctgtaaatccgtctgtaaggtatgctccgtttccatcatctttcacgtcgcatccaggagcgattgctgcaagcggttccggtccataggcaacatttgccatctcataatagttcggaagctgatctgcactgattgtcatagaaaattcgtaatccccaagaaggttaacacctgcgaattcttttgttgttccctgtacatgatcgttgtatccaactaaagcccatccgtatgttgcatcaccttcacaggctgcaaattccggagaagaatgaagcagaagactgaatacataatcttttgctgtaatcggagaaccgtcactccatttcaggttatcattgatttcaaaacggtatgtcttgcttccgtcatcgttttcgattacttcgtgatctttaacaacaaccgggtcccaatcaagaacataatcacgattgtaatcagcgagggcgtaaccactcatcaatccaatgaatccggagtttgttgcattgtttgaccatccgccgtacatatccggtgataaggtacctggtgagatcgcaactacaacctgtcctcctacaggtgcatcttccggcggtgcactctgcatgtcctcggttacctcaactccaacctgtttgctttcaccatcatcctgattattctggttcttgctggaagctcctccaccgccacaggctgtgaccgagagtaccatgataccagccagcatgagggctatcattctctttttcattttgcattcctccataaatgtaaactttgtgttaagacaattataacattttaccaattaaacatctattatcgttttcgtttttgtgcatttttgtggaatacgacgtatttttattgtatacaaaaaaacaagtctttcatggacggattttactacatatatggacgatatctgtttttcattcacacacatccagattgttaacagtctacaatttgtgcatttttaacaaattgttaaatgttgacatttgactaaaaacaaaaaaatcttgttgcaacaaaatcatttcaatatcgtttttttattaaattaaaaagtctatctgcagtatccggtcctgttttgccagtttgctttgattgattaactcctacaaatgaattcttcgaaagccttgttgcaaacacaagataatccttaaacaactcgacagcttcattctgaataacatttgcagcgataataacgtcaatgcctggattatgattctttaactcatcaataatcctcattattgattttccagtattaatcacactatcaacaataactactctctctgtattaatcacaggagcatcatcttgcttcgggttcatcgaataaaaaatgccgcctgctcccatatatactccgtcaccaaaaaacctgccacctcgttccaaaactaagattgatgtatttttctctgggaatacggcagcaatgtgccttcctattttttctcctaaacgcacatgtgctgctgccagcctacttccacttattcctgaattcgatttgcagatagcaatatcagcttgtacttcttcgtcctcatcagccaatatcaccaaagaatgatcgtaaatcggcaccaagcctgataagctttcattcttcaatgatctgcttattcgcttaccaatatacagaaatcctttatcagcctcgcgtaacatatataaatcaatcttgctatctccataggcaaaaatagtgtatccatgttctcgcaattgctttacgacataatacttaacatctgcacttatgtatggactagcaaatatagttccaagattcttagcattagcaatatcgctccacaaatcttttattccagaagaaagtacaacataattattcgatgcaactatgtcatacacttcattattaattgttatctctgcaattttagatttgtcaatagacgcggtttgtaattccttttcaaaaagaaatgattgatagccagtataaaaatctccatcgaagatctttgtcttgccattacaacagaacctatatgaatcttgaataataatggttttatctccgtcaaccatatacaagatatcctgcttgttgaactgctccattatttgattacagatatctgtcgctaaatcgtaggagctgaaaccttctcgaagtaaagataagaaatcaaaaaacttattctgttcttcttcattatcacttacaacgtaaaagtccttatttcgcctatgacattcctctctaagattatttatttcaaattcctgccattgtcttaacgactcaatggactcgccagcaaacttaccatttttctctgacaaagcatatctttccttaagattttccggagaacaatacagataaataaagatatcgtacaactctccgtcagcctcagtaaatgcaacagtttccataaatgaatagtgtccatctgaaacaattacttcatcattcaaaccattaatatattctgtgtatttaattctaacttgatgtttctcttcttctgatagttccaaaaaggaaccaccgcaaatacgtctcaactcctggctgccattaataacctttgcatcagtgattctatccatcaatgtacttttgcctgcacaaggcattccatataatgctatcttcaaccagtaaacacctccttgaaacaacagcttctgtcaaaatcgataacgtcaaaactgacctcatttagaggtgtgtcgtaaggcattgaaaaaggtaaatcgatacaattaccacatatgaatatctttccatttgcgtaaaaaatattatccattcctgcaccacacataccaccatacatggtacagtcgtagccaccagttctaacattcaatcgttccatcgccttattcaagaacgcattaaaatcaggtaacgatatcccctgttttccaatcatcctagaaaacgtgatcctattaccaaattgttcaaagaaccctatggtcgcttccggattatcaattatctcttttccaacagtacaattcatagaaggatactttccattcacttctttgtataaagctatatttgccatcactcgctcatgagttccacatctatacttgtcgtgaatagcagagattccatctactgaaaagccaacatttacattgtattctttgaagaattctaacttctcacgatcaactaaaagaccgtttgtaatggtgtatgcagcaattcttccagatttcaaataatctccaatatgagcgatatactgcttaagtttctcataatctaacattggttctccattacccacgaaccctaacttaaacaaatcaatatcgttgtcttcaatatgtgaagcaataatatcaaggatagtaattacatccatattgtcctcttgaatgtaatccttcttctcatgaaaatggcaataagtacaattgagattgcatcgattatttatcgatatacaagctcgtgttaccatcttctattccccctcttctgactattcgtattgttacctctattaaactgctttcttgtaggaccagattcatgatactcactaacccaatcagcagctgttttaccatcaatgtcaacgatcttctgatcagctcctgcatcaatgagtatctttcgaatatcccaagtatgcttttccttattattttcaaagtgaccattcatgcaggccttcatgagcgcagtaaatccattagcgtcctgctggttaatactggttctttcatcctcacataaagcaattacaaaatccttctttctctcccaggcagcaatcattaatggcatattgccctcattcttctggcgtacttttccggcatcaaaaggatttctacttccaacattaggatttgccttacactctaaaagcaaaaacataaacatctcataatccttcatctgcactgcatgcgatagagcagggaaatatctacgactgcaatcacgcttattcacatctgcaccaagctgaatgagccatttaattttttcttttctttgctcaattgtggccctattatttcttacagcagaaataataagggtatttccatcctgaagatatgcattaacttcgtctgctgtcggttcttcgcattcctcatatgaatctgcgtaataagcgtcaattctagccaatttagtcatattgataagatcctgcttagtagccatatattctctaagatgtaatgctgaaacggattcataccctttaagatatgctgaataatcggtgtcctctgttatgatatctactttgcagtgatatgtatcagaagcctcctgtgcaatatatattattttgcaatcttcgttatcttcatcagcatcgccattatattccataagaattgtacgagaaccatagctaataccacgaataacttcccaagcctttctcccaagagaacctgagttcttattctttatattatctaattcatcaacaactacctttggaataactaccttgctatattccttgttcagttcatcaattaactgtgaatttttaagtaacgctgaagtatctggaactgcaaccttctcccctctcaaaaattgttcggtctgtgattctgacattccaaaaaccttacaatattttcttgccatttccaatagagttttttctgcagtttttccaccttcaacacgtgaaatagacgacttgttcataccagttcctggtttcaagccctctaatacatcaatcttctttgccatgtcatccatggtacagccattcttttcacgaagctccttcaatctcgaacaaaggaaagctatctgattatcatttgccataagtaatgcccctttcacaggtatgtaatttgattattggctttatctcatactctcattatatacatcgttgcatttttcacaacgaaaaggggtgtttttgcaacaaatattcaaaaggcgcaactcatcactttatttacttaatatatgcaactaaatgaagctacttgcaacaacacaaatgtggtttttttcaaagttccgtttttcggatcaacgaaaaactccacaatgaaaacaggcccttggcctaacaaaaataaccttctggcgtaccactggaacaagtacgccaaaaggctttctggtgttaaatcattttcaatttttcatcacacgcacatatttttccgcactattttgtggatatttttattaaaatagtgccttcaaccccgcttaaactgggcatttctttgaaaggagacaaactgtttcaacggtactttcgttgtcccaacaaagttcctgtgtctccctgtctccaaaatacaccggaaaacggaactttatgtgcttcaggaatctgccatctggctgctcctgctcataaatgtccacctgttccacaaagctgttaagaaattctttcttctccaggtcggtgaacttatcatatagtttatcaaaatataaaagaaattgatagacgttttcttctgatattttctgttgccggatattcagcaggcgattcttaacttcttctatactgttctccacgccttcaatttcatcatacaggcggtataaccttgtctccatatcctgatatttcttctcataaaatttatccatgatatccaggctatccatctgctgtccaagtcttccttttgctccggtcagctgcctgtgctgtttttccagtctttcaatctctttttctatttcttctgtatctattcttgaaccgattttattcagaattgcttcttcaaatttaggattcttcaccagcttccgaataacttcttccactgcattgttaatcttctcctcactccattgtttacgatatccacatttatgaccatctaccaggcgacgatgtttgcaggcataatagaaataatccttatataaagttccgtctttctttttctttcggttcacgtttccatacataccacttccacataatgggcatctcaatattccggataaaatatgctcatgatcgagactatgtgtcttttcatatttcacacctgttttttcccgtttttgatgtgccagctcccagtctgtttctgaaacaatcccttcatggataccatcgtgcagcatataattttcctgctttacaatgcggtattcatttcttgtaccagaaactttctcgtttttccttcgtccataagccagctttccacagtataccggattatccagaacgccctttataaatgaagcggcaaatgcgtccagtgtattattctgtcgttttttctttttgtatccatgctggttcagccatgcagcaatcgcagagattcccatattggtatgaataaatttgtcatagatcagatgaataatctctgcttcgtcctctgcaatctgcaattctccatttactaattcataaccatacggagcaaatccaccattccattttccttccctggctttctgcttacgtccttccattgtctgaacaaggatattctctcgttcaatctctgccaccgcagacagaacagaaatcatcagctttccactatcttttgagctgtcaattccatcttcaacacagatcagattcactccaaaatcctgcatcctctgcaaagaatttaaaacatctgccgcattacgaccgaatctggaaagcttgaacaccagtacaaactgtacctcatctgttccattctcaatattatccaacattctctgaaattccggtctgccctctacgctctttccagacttaccttcatctgaatactcatttacgatttccatattctgaaattccgcatatctcttgagtttttctttctgagcatccagactgtagccatctacctgcatggttgtggatactctggtatatatatcgcatttaatctttttattcttcataatcttcctcgcagtataactctgtttcattgtcccaaccttattttagtacttgttccaactattttcaatacttattttccgtattgacgcatttcttcgccaatcgtataattaagttagatacagagcatttctgttatcaaaatattgcccgcccaccattggcgacttataaatgattggctcgaaaatattgttcgcttaccggaagcgtctaataaatgtccggcttgaaaattatttagaaataatttctgtttttgatattgtgtttttatcacacattgcatatactataaatacacaaaaaagccaaaaaagaggaggtgttagtatggctacttcaagtattactcataattttgtcgtatccaatccaaatagcgtaaagcgttttgtcgcagcaattgacgaagccgaccgtgaccgcacaccaaagcagacacttcccggacgtcagttaacgaacccacaggaaatcttagctttaatgtcaaaaaggaagaaaaaacatgtctgataaatattttaccgttaatattcgggcatatttggataaagacgaaccgacatatatcggagaggaaagtctttacgacttactctccgatttttcttgtcccaaaaatcccgatgtggaatactttttattacataatgcgattgagtttaccaaaaaagatcaatctatcacttatctggtatttgatgctgaagatgcttcactggttggttatttttcacttacaataaaaccaatctctgtccgtgcttcaaatatcagcaagacaatggcaagaaaactgtcccgtgtcagtattttggatgaagaaacacaatcctatactaccgcagcttacctgattgcccagttgggaaagaactattctcttccaaaggaaaaacgaattcctggaaatattctactgggatttgcactggaaaccatatccagtctcaaatattccgtaggtggcgttatggagtttcttgaatgcgaagataatgaatttcttctgagcttttatacgcaaaatcatttcaagccatttgatacgcgtattaccgcttctcagaataatgagccacacactctgcatcagcttttaaaatttatttgatttaaaaatgcatgaaaaaagcgacagtctgatttacattttgtatttcaggaaactgccgcttctttttcttccttattctgtttttcttcctccaactcccggaggacttcttcgccgtacttatcaatcatccgtaccagaaaatcaatgcaccgctcaaattcaatattctgttgcataagctcctcccgttattgtttgttctgagcttattttacagaacctgcctgaaaaccacattgaataggaattgattgtaaattgacacaatcactttaaaaatattcgtattttcttgaatcgaatatatgttcgtgttatgatagatatactcaatcttaactacgaaaggggaatttctattgaatcgatgcgatttttcttctattagcacttgcttaaaaaatcatatcagcgaaagtaatcaaatgagtcagcctgattttttatacgaattatttgaagattttatggatgatccggcaaatcaggatttttcaatggataacggtctggtttgccgctggatgactggtcaggctaaaatcagtcctaaaatatccgcttactattccaagccatccaatcaggaaaaattagcccataccatccaccagaatcttcttccactgatgtctgactgtaatatggctatacaagatatttacactttattcattcaggatgacagcatctcagatgcgaaaaagaaaaatctgactcccttatataaaccagccagttcaagactgctatttcttgcaaaactgatttcttttggcatggaacgccaattcatcaaacgtaataccaaaaatcagaagctgctcgccggaggcgctttatcccctattgtgctggattatattatggacagtgaggttccgaaaccatgccgtcattttatcggaagagataaagaactagaagaattatataccatgcttgaggaaaaccgtcatgtttttctttgcggaatcgccggaatcggaaaaagtgaacttgccaaagcctacgcaaagcggtacataaagcaatacaccaatatcctttatgtagaatataccggcaatcttcatcaggacattactgacatggattttattgacgatcttccggaaagcactgaacaggaacggtttcaaagacataaccgtttcctgcgttccctgaaatctgatactctgcttatcatagataattttaatgtcactgccacacaggacagctttctgtcagtagtattaaaatatcgctgccagattttatttacgaccagaagtaatctgaatgaatactgtacttttcaattaaaagaaatacaggatataaacattcttttccaactgacatctgcattttattcagaagcagacaagtatcgttcgaccgtcgaaaaaatcatagagaccgtacactatcatacttttgctgtagaactggctgcaaaacttttggaaaatggaatttcaactccaggtcagttattagcaaaacttcaggaagaaagagcatctctcgataatgaagataaaattaagataatcaaggatggtcaaagcagtaaagccacttattatagtcatatccatactctattttcactatatgctttatcccgaaaacagcaggatatcatgtgcaatttgtgttttcttccttacactggtatttctgcccgcatattcgccaaatggctggaactgcctaccttaaatgaaattaacgacttgattgaaactggttttgtgcagacaactacacgtcacacaatctccctgcatcctatgattaaggaaattgccctttcagagacaaaaccatctgtaagtagctgtcacatattactggattctttacagaaaatatgtttaatgcatggaatggaagtagcttattacaaaaagctatttcaaacaatcggaaatatcatagaattgattgaaaaggatgatataccaaagtatctgctttttctggaaaatgcatttccatacatggataactataactaccacaaaggtatgaatggaatcattcaggaactgacggggctgttaaggacaaaaaacattggaaccgactctgaccgggcattattactagattttcaggcaactcttgaaaccaaacctgaaaaagcaataaaactagaaaaggatgcacttgcccagatagaaactatcactgctgacaatgctcgccttgtttccaaccttcatgccaatctcggtggactttaccgcatgaacgctcatcccgatcttgcaaaagaacacatggaaaaaagtatctcactgcttgaccaatttaacctgcttcatataaatgacagcatacctcagattgccaattatgcaatgttcctgacaaaacagcaggaacccgaaagaggaatctccgaattacaaaaattatccggcatcatcaaggaataccattccgatgactgtctggattatgccaaagtacaggaaacccttggaaccatttatctgatgactgccaatcttccgcaagccaaaacacattttaaaagagctttcaaaatatatgaaaagatctgggctgatgaaccagaaatgattgaagcaaaatatcaggaaattcaggagttatatccacagattggattttgcattggaaaaaatctatccggtcttttaacaaaataagcataatttacggcgggcaacttgcccgccgtaaatctttaaattatgctttgatttttccagaaaatattttacttactttgttttttatgagtatgaatacaatttttacttatttccgtatctgcgaaaactcttataaataaaaggcagtaaggctattgccatcactgtatacattaccattacaagcggaatttgtcgaaatacacaattcccaatctgataaataagtgggacttttacacttgcctgtacatttgtcaaaattgttggtatcaaattgaaaagcgttgtatacccagaaagtgcccgtcctataaatggcaataagcaatataaaaagaacggaatgcaaacagcgacactaattgtatgcattttagccgctactaacatagacactacagccgccagcatactggctataaatccacatacaactgtcaacaaatagtattgtccatatgacataatgtaaatactatacgcctgatacatttgataaggtgtattcataccactggttcccataattccaaaacaaatcacactaagtaatataattcccatacaataaatcataactgtcgtagctattcctgccagtatttttgttttaacagcttttgtacgtccatactttgtagagaaaaatactgcatctgcttttgtctgaaaatcatctgcaaatattccagcacaaataaaaccaactatgattgccagaataatagaatacgtttctacatacataatcatagtatcccatgaactataagattcgtattctactggtaattttatttcattatatttcttttccaagtattttttctgtacagaagtctttccatattcttctgccatcttttccatatttttatgataagtgtcatagaactcttgcacattttcttctgtaatttgattcagaacactttcatcatattctgcatccggtgttaataccgatattataaaccccctaatatcatctatcggttgtaatgtcgttccgtaaatcgcattttcttctgaggattgtgtcatcgcatttttattttgttctataacttttccaagttcatcttctgtcaatgtacctttccatgctcgtctgttatctgtaagttttcttgttgccataattccagtactagcatttccattctcatccacatagcgattacttgtaactgcaaatccgctaaaaatgacagcaagtatcaatgccaatccgattgcaaatacattaattttctttgaaaaaattcgttttaattctaatttaagcatcttgtttttcctccgatttttctccaaaataaaatagaaatgcatcttccagatttttttctacagccacagcatcttctgttggcttttctattgaaataattctaagctctgctccggtttttgttgtttttatatttccaaccaaatattcactcatatatttgtctatcatacttctcgaaacattacattgccataccttttctttcatagaagatactaattcttccgcggtacctgcataaaaaagttctccatctttcattaacataatattattcgcaatgtactcaatatccgatacaatatgtgtagacaagagcaccaaacgttcttccgacaattcactaattaaattacgaaaacgtattctttcattcgggtctaatccagcggtaggttcgtccaggacaagaatttgcggatcgtttaacatcgcctgtgctattcctacacgtctaaccattcctccagacaaattcttcatttttcttttactgaatttttccattcctacttgatttaataattgcttcactttttttctggcaaacggtatttttaacccttttatagaagaaatgtacatcatgtaatcatatacggtcaaatctggataatatccaaaatcctgtggtaaatatcccagaacttctcggtattcacctcctagtttccatatatctttaccattccataatatttgtccttctgatggttgaacaatcgtacaaagcatacgcattaatgtggtctttcctgctccatttactccaagcagtccataaattcctttttccataacacaattcactttattaacagcatttacttctccgtattgttttgttacatttttaaattctaatttcatacgtgtaatcctccaaaattttttcatcaaatagcaatgacttctgaacacaaaaaataaaatatacaaaagtcaatatcagcataaccacccataccggagttacaattttctgataaataacatcatttgcaacaatcatcatccataagccaacccataccagacaagaaagcactgctatatattctgatttttcccatctgctgtacaatacacgaaaacatatacaacatgaaacatttaccggaagcaaaaaattaaccaccaaatcacttaacgagagtattgttgtttgatatgtaattgccaaaaacaccataacgatcaccagatccactactccaaacattaacattcttgctgtacaaatctgacgcagtgtgtaataagacgcctgctcaatctcaatcgcaccatttcttctgtttttccaaatttccgggataatcagaaccacaaatattgtggcagatattcccataatcctcatcatatcttttatgtctgacgtataattactcaaccatatccatagacacataagaacacaaccttgtaaaatccaccatcttttttttatgaattttgtctgctcatacaaaaattcaaaataagatgttctatgcgattgtttcgataaaaccgactctgacaaaatattctgacatgcttttactgttttgttctctgcttcagcccttacatacttttcttcaatctcctctttatattcctttatttgttgcttataattcttcatcttttttcacctccaactctttcattaaaagttcttttgctcttccgattcgatattttacaagagaaagtttgatatgaagtaattctgcaatttctctttgcttcaattcctgaaaaaaatataaaactgccgtttctctaatttcttccggtaactttctcactgcctgttcaatagttaatcggactcctagctcttctacatgatttttactacagtcctctgattttagcagttcctctgatggaatatcttttttctttttgtaataatttttaacggtatttccggcaattgtataaagataattcttaacttttccatattctttatatctatataaattggaaaagaaacgtgtaaacacttcttgtgtcaaatcctctgcctcatagggatcattgatatgtagcaaacaatattgatatatacttgagtaatattttttgaccagtttttcacacgcatcttcatctcctgctcttgctagatgtactaacaaagaatcagttttgtattccattcgcaaatttgcctccctctgttttctaaataatataacaatcctactataaaaaaagttaggattttcttttgtttttatttatatttttctaaatattcttccaaacataaattttcttctttcattattttagcgacagtcgttccaacataacggtaatgccatggttcattactaattcctgttatatccgttttatcttccgggtaacgttttacaaacccatatttatatgcattttcgtctaaccattgatatactttttcagaagaacatttgtcggtatccgcattaatatcaacactcagtcctaattggtgttcgcttgtatcgggaattgcaacatatttctcggctcttttttttgcttctttcgcagaatatccttgtttttcatattcattgattttctcgtccataattttttgttgttcttctgttgttcgatatccttctctaacaaacagtgccagcccctcagctcttgcatcattaaacatttgttgtaattctggataaatccgtgaatctacttttttaccattcgataattctgtcaattctacttgataattatttggaatataatgatttcgatcgaccaaaataagattccattcacccgaagtgtctgcaaaggacttttctgactgcaaaattttcggtaatgttaattttccaacctgcacatcgatttttattgttctccacattacaacggttattatgatagtcattaaaagaatgaatactcgtaaaatattctttcttctacgattgctgtatcttcttttgttcattttctctcccacactttcattatcaaaatatttctacttttaatataattaacaaccaaaacgacaaaagagttagtatctaaacttatttatcaataaaaagtttattttttctcaattccagctcaatttcccctcaatgcctttttcctccgattttcgtatgcttatcccacagcagagcagtaccacaccggtacgacctgctgaatcaatcaatacgaaaacggaggtattttttatgcgagaactcagaaacacaaaaatcattgctgtagatcatggctacggcaatatgaaaacagcaaacaccgtcaccccaaccggcatcaaagcctatgaaactgaaccgatcttcaccgggaatattctggaatacaacggcatttactaccggatcggcgaaggacacaaagaatttatcccggataaagctatggacgaagaatattatcttctgacactaatggctattgcaagggaactgaatgtcttttccatccgtgaagcagatgttcatctggctgccggacttcctctcacatggatcagaaatcaaagagaagcttttcgttcctatctgctccagaatccagaagtccattacctttttaacggcaaagagtatcatctccgctttgtgggatgcagcctttacccacaggggtatccggctatcgtaaaccaactaggaaatttcaagggaaccaatctccttgcagatatcggaaacggaaccatgaacattctgtatgtcaacaataagaaagcgcaggagagccgatgctggacagaaaaacttggtgtaaaccagtgcatgattgccgcaaagaacgctgttctggacaaattcggagtgaaaattgaagaatccacagtagaacagattctgcggtttggaacagctgacatttcagcaccatatctggattgtatcagttctattgccagacagtatgtggcagaacttttttccacgctccgcaaatatgaatacaatcctgacctgatgcgcctgtatgtggttggcggcggtggatgcctgatccgtaacttcggaacgtatgacaaatcacgagtcacaatcattgatgacatctgcgccactgccaaaggttacgaatctctggcttatatgagcctgaaaaggaggggataaactatgcagaacaatatccgcaacacaaacctgcgctttaatctggacaaagaacagcagcggagagcctgggaatatttacagacgatggacaggcaggattttaaatcttacagtcaggtaatctctcttgcactggtagattattttgaccgctactatcgcacacaggctgatccttatctggaaacaagagaacgggaagaactttttgtgaaacagattgtagatgcagtggaaaacagtctgaaacaggcattgccactttttctttctggactgactgcaggcatggtgcaaagggagccccaaatcagggcgtcctttccagcacctgaaaattcacagccagatagtgatgtagactgggcttttcttggagaataaacccttttgattggaggtgaacacatgactgactttctgacagcagacaccaacctgccatcttatatgatgtttccccgtttccttctggacatggaaataaacgaaactgccaaaatgctttatattatcctgctcgaccgggcaaggctttcccagaaaaatgagggctggtcagatacagatggtcatgtgttcatttactttacgattgaagcactggcagaagttctacacaaaagccagatgactgttaaaactgctctggcagtactggaaaaacaggagcttatcttccgaaaacggcagagacccggacagcctaatcggatttatgtaaaactcccaaaagaaaccatccactatacagacagatttctttccctaagacagacagaaaactgtcctattgacagacaggattctttccctgatacagacagaaaactgtctggtaataagaaagagataaaaaagaacaatttagaaaaaagagggagtaaggatccactctcaccctatggaaaatttcaaaatgtttttctgtcagaaaaagagcttgaagatatccggcagacaatccctgactggcaggattatattgaacgcttatccggttatatggcttctaccggaaagcaatatcagaaccatgcagctaccatcatcagttgggcaagacaggatcatcctgcttcccggcaaaggaattacgaaagtgaggaatacgaaacactatgacaagatttacagaaaaagcaaatgctataacaccaaacagagaacttcagcctgatgaatattttaacgaaacagaccacctgatctactgttccaaatgcaatacgccaagacaatgccggcatgaattacagggaaaggttcttattccttccatccgctgtaaatgccagcaggaaatctttgagcaggaagaggcccagagaaaacttcatgaaaaacaaatggaaatagagcatcttaaaaccagcggcttacaggacaaagcactctatgactacacttttgccagggataacggcatcaatccggaaataaaactggcacacaattatgtaagcaactgggaagagatgaaatcaaacgcttccggacttctcatctggggtgatgtcggtactggaaaatctttttttgcaggctgcattgccaatgcccttctggaaaaaggcgttcctgtactgatgaccaacttttcccggattctaaatacccttaccggaatgcattttgaagacagaaaccagttcatcaacagcttaaaccgctacagtcttctgattattgatgatctcggaattgagcggaactctggctttgcactggaacaggtattcaatgtgatcgacagtcgttaccgcagtaaaaagcccctgatcataacgaccaatctcactttatcagagctgaataacgccgctgatatcgcacacaaacgaatttatgaccgtattctggagagatgtattcctgtccgtatcaataaccggaatattcgtcaggacaatgcaacagctaatttaaaacaagcgaaaaaaatcctgttgaacaatcattctcctaaccagaatgaaatcaaagaagtataacacaatgattatttttcactgacagtggtactactttctttcctcatttattaccggaaatatgtcactgtcagttatctaaaaccatagtaccaaatcaaaagattttaaaaccaaaactgcccggatacgggcataaaaaggaggtgccagatatggcagataaaaaaattatgacaccggaagaaaaagcacttttacaggcaagacaccgccaggaagaagccgaagcaagaaatcgcaaaaaagaacgtgatgccagaacacaccgattagtccaggaaggagcaattctggaaagtattgttccccatattaaagaaatggatttagattccctgaaacgggagctgatgatccggctacggggaatgtaaacgcacaagttctactcccgaagggcgcacttactcaccacctgataaatcaggcagtggtatccccttcggggctcgtgcgctctgccgagggctttatccgctgttgcaggcaacatcgaaaggaggtgccagatatggcaatttatcatatgcaagccaaagtcgtcagccgtggttccggtcggtctgctgttgctgcttctgcttatatgagctgtagccggatgtacaatgattatgatggtatccagcatgactataccagaaagcatgggctaatctatcaggaagtgatgcttcctccaattgctccatccaaatggattgaccgggaacaactctggaacgctgtggaagaaaccgaaaagaccaaagacagccgactggcaagagaatttgttgtcgcactccctgttgagttggataaagacagcaatatttctcttcttcaggattttattaaaaagaattttgtagatatggggatgtgtgctgattttgccattcacgatacagatggtcacaatccccatgcacacattcttcttactgtccgaccactaagtgaaaatggaacatggcagtataaaaccgaaaaagaatatctctgtatcaaagatggggaagaaaaaggatttactgcttttgaatttaaaactgctcaaaaacagggatgggaaaagcaatatcgctataaagttgggaaaaagaaagaatatctgactccatcttccgcacaggaaaaaggatatgaacggattgataagcaccccaagagcagccgatatggcagacagaatcctatttccgaacaatggaacagtgatgaacaactctgcatctggcgggcaaactgggcagatgccgtaaataaaatgcttgcacgtaatcagataaatgctgccattgatcaccgcagctttgcagatcagggaatcaccgagcagccaaccatccatgaaggctacattgcccagaatatggaaaagaatggcataatatcagaccgttgtgaaatcaaccgtcagattcgtgcagataacaaaatgctccgggaattaaaagctcaggtagcaaaattggctgaagctgtagaaaaatctattccgataattgcagaaacattggaagcgatccgcaatcatatgatttttacacaatatcatttacttcacaatgaaatgcaaaaagaagtgatacatgactggatgaatcattttattccaatactgaataaatacaacaccgtcaaaaagaaactcaaagcgaaagttacggaacggaaagaactgaatgtgcaaaaggataaaaccagtattttgaatcccatccagcatataaaattgaatcaacagcttaccactgttacagaagaaatcgaagaactgaaatcacagaaagaacagctaatcttccaggcacaatgctctaccgataaagatatgacgaatctatccaagaaatatgaccagatgaataaaaatctggatatcttggattctcaggacacttcgctcaaaaagcagctaaaaaaagatgcttccgctttccgggaagaaaaatttcgtcctgatccagaacaatatacagaattactggataccagaatccagatacgtcctgctttccgggataagctgattgaacagcttaaaggaacttttggtaaatattatgactatcaccgccgtgatattgccgccaatgaagtggattatctgaatgttgaagatcctgatgtcttctcccatcgtgcctgggaacttgaatgtcagaggaaacaggagatgcggcgaaatcagcccgtcaggtctagaaaaaattcgtatgatatggaattataatttaatttttaagcctaataaacgtcaaagctggacaaaagggatttttcgtcctatttgttcagcttttagtttacccgtaaagcaattcttttaacacaatctcttccgcaacattccgaatattgtttacagctccaaccgacaccatctggctacgagcttctaactcatccgaaacgccttgcctctccatcatctttctcaccagaatttccattctctcctatgtcatctggtttctgttgggaccaaagaacaacatctccacagcattgaaagtttcttcttatgccaaataacaaaaacgtcaccttttgcgaaaaggtttatatcacacttaaggagattgcgtttaccccatatactttccaaaattcacaattattcatttttcaaaaatttttccaaattagtttcaaacttagaaaaatcaatatatttttttgcaattttacaaataccttccacaaatgccatctcagcaatagaacgcttttcaaaatctgctcggataatcttatacaattcttttccatcttcatccttttttttatttgtcttaatatattctgctataagattatctatagatttcacataaaagaatttgtcatttatctccttcttaatttgcatatctacttctgtaattaataccttcttcaaaaacttttcgatacttcctataggtataaaaagttttgggtattctttatactgttgccctacctccttttgaatatcaccatccaaaatactaaaaatctttgtccctgcgccaaaagtcgaatgtatatataattcatgttgtaagttcagtacattactccatccacccacaggcaaaatatttataagtttacttctagatatatctttttcatcaataattgtttgtacaatattctttgccaaatagtcttctactaaaaccacaaaatcaaatccatcatgcatgtaaacatctctaatagcataacttggataacatggggtattgacttctaccagaccttcttctctctttgataactctatttgaaataaattattcggctgaatagttctaattacttcaggtgaatgagaagttaaaattaccactaaattgtgatgctgatctattaactcacgcaacaggtccagtaatctaaccactgctattgggtgtaaagctaattcaatttcatcaatcaacattattattggtttatcctgtggcaatgatcttctaactattgcattatatataaaatgtaataatgatactaaaagacattcgcctgaactcattctatattgacttattagtttacctctatactcttggaaatatggtgtattctctaactctaaattagcagctatcttcttatttcgaattctctttaacgttctgtaaaaactataattaccatgtaaaatataactcagattatctttaatgtagtcatctgcttccactatatcctcatcatgaatttgcgatgtagcaagtaaatcatctacaattttagaatcattgaatctagttccatagaataaacttccttcatacataccatcataatgaactctttttcttggattttctactgttttccatttatcaccttgtcgaaaccattttgcagttttttctccgtcacttaacaacacatacgactcttcgtttatatcttcttcccttaaagcatctaaactatgtgaaaatacagcttgtgctaaacaggtcataatagtgctttttcccgttccattgttaccaataatgccataaatgcctcgattaagaggaatagagacttttgccttctttatattctttatttcactaatttcaatatctaattctctcaatttcttgtcctcctattgctctgatatctgagatatttctttgtttaaaattaatcaattttcccgtatctgttttaatcctaagcaaatacagtaaggcatatgcgcgattatacaggtattcaataaaagccaagtcctgaataggctctcttgtctgcctcgccttattcaggtattcattgtgccgtatatcaaaatattcattggagattttcataatctcctcaatttcagccttaacaactgcatatactttactatcttcatcttcattgacactttttgcagccaatttatatttttgtattactttttcaccatcttgcacagacaaaataaattgcaaggcatctattatataatccaatgcactctttttatccaaatattcccggctcgttatcatttcttctgaataacgaatctttctttcaaacatagggtaattcaaaattttatctaagtaatatgatgttttatacccttcttgtattaatcgtccattttgtaatctatgtggaattaaaaaacgacttagccgtttatttaccataaccgtaaaatcatatcttttctcaaaaattatccattcatgaaatgcaagctctataaacatttttatatcttctatttgaggcaattccaatttcaaaatgtccggataagctatcccatagtgtaatctatattctttttcaaaatctatccctaaataataagttccaccattccaattgtcataatcttcataatatgcctgtaaaattcctgttcctggtaactcatcttcgaaccatgtagtaaaactcaaccaaaatttttttatattatccacttttacaatcggcaaatttgtatcgtccatttttgttccttcttccttaatcagaatatatatattttatcatattgctttctcttttaccatctgcaaagagtaatagaaaagctgatcaggaaccgcaactcccaatcggcatctgtgtcctttttatattttccagcaaatcagataaaagaatttctaccatccaagatttattcctttatactagcaaatcgattttacgcaatgaaaaattttcatcttttctacatataatgtgcaacttgctaggtagtaattaaacatagcgaaaagctcccgaaggagctttccacactttaaatatacactaattcttttaacacaatctcttctgctgcattccggatattatttaccgctctgacccattccatctgatcactagctttcgattcttccgtaatgccctgccgctccatcatctgacgcaccagaatatccattctctcctgtgcttcatcgtccacaagattcagatgttccaccagtctgtcttccaacatatacagtgaatacattgccggacgatactctttcagatatgttttccgcatcattccatatttcccataatgcggttcttcatctgtactgacaagattcgaatagtaaattccgtctgcgccaagtgtgtaggttccacccattttttcaaatgtacttttcacgtgttattcctccttgaaatcagcgatgtccttagatcatcgcataatatttcagggcagccttgatagcatcttctttctctttcgggcattgcggaactcttgcattttctgattttggaagattatagttttctcccacttcaattccacatttgcgttttacctgagaaatatataaacttgaaaccttcaagccaaattctttcagcacataatctttgatttcctgataggttgctttcaactcggcactggtggcatccagctcgtccaggtctaagtcgatctctatcgtgtcatctggtttttgttgggacaaaagaacaaccgtctcaacgtgctccgtaaacgcaaacatttccaccggctgtatcttttttacctgatatcctttttttgtcagatacttcagatctcttgccagtgtctccggattgcaggaaatgtacacgatcttctccggtcccatcttcactgcagatgccataaatttttcatcacttccggctctcggcggatccataaacagcacatccatactatttccctctgctgccatcgcctccataaactccccggcatctccctggaaaaatctcacattccggatctgattctcttttgcatttaatattgcatccttcacggcatccttattaagttccacaccgactacttcttttgcatgtcccgatgcgatcagaccgatcgttccgattccgcaataggcatcgatcacgctttctttccctgtcagatgtgcaaattcaatcgctttctgataaaggatctccgtctgcaccggatttacttgatagaaggactttggtgaaatccggaaagtacacccgcagagttcatcccggataaatcctttcccatataacactttttctctctccccaaggatcatactggtctttctgtcgttgatattaaggacaaccgttgtaatctccggatgctcttttctgagtgcttttacgaaattattagacgatggaaggattggtgatccaagcaccagaaccaccataatctctccgcttttaaaccctcttctgatcagcacatgacggaacaggccatatcctgtatcttcatcgtaggttttgatcttaaaagatttcaaaagtccccggatcgtccggatgatctcctgactctttttgtcttcgatcagacagttttcaacaggaacgacccgatgtgtcttcgcttcataggttccggatacgatatttccctttcggtccctgtcgaatacggcgtgtactttatttctgtaataatacggattctccattccgatgatcggttctacttttccgtattttgacaacagagcgttcaccattttctgcttctttttcagctgctccttatatggcactccctgatactggcatcctccgcatttttttgccactttacaggcttccggttctgtctgttttttcttttcttccattttttaccctctcttcttttttcattcttttctcaaaagagatccggcatattatccagatacaactcttctctgacctggagatggtaatatgctttttttgtatctgatgtattcattcttataacccttttaatcgttcagatccgtctggaatcttgataaatgttcatacggcaggatcagtctccccctgtataatccacatccgtcattgatgagactattatttgccgcagcaaacatattgacttccagatccttcagttccaaccccagaagccgcattcctctttcgtatgcctcatcaaaataaatgcattctccttccggaatagcttctcttcttgccctgactctttcctgttccttctcgtaggcctggtgatttgccgctccaatctccgctatatcatccatcttctttgtccgcagttgtacttccatgtaacttctcgaacagttatcataaaacgtgatgtggagtgattgatagctgcctccgcttccattggaaatataatcccgataataaggtttcaccgcctcatccataaaaggagatgtactttcaagcaccccttttgcaggttctgccgtaaatcctctttcctccagaaatcccggaagaacattcgcgatcctgtataaatacttgatttcctcttcttctcgcagtttgtcatccttgatatggcattttggaagagaaattaccagacggtatgcgataatatcccgaaagcagctcagtttttcccttaggtcaggcaccggcggataggtatgatgtttttcataataatcataaatatattctacaatatacccgttgaatttttcctctgcgcggatcagggacttgatccttcctttgaaagtaaaagcaagcagaggatattcctgtaccatgtatttataaaaatccctgattttctgcgactgtgcagtaaggaaatcattgtgttcaagcagttccctgaactggatcaggaaattggaatggatgagatctatttcattgtgattcttctttgcttctttcttcagatccactgtataatttcttaaaatccgaaaaatcgtatcacctgaatataaatagtcatttaatgtgatcatacgttccaccctttctatttgattttcttatacagtatagcagaatctggctggattggataccgttttgttaaatagaagcagggattgatctgctgcatataatctagcaaggtcaatccctgatttatcatatttctaaaataaaagctgaagccccatagcaatgatcacatatacgcacatgtcttcagaatcatcaagaatctgacttttgtttttgttttactgaatagtgttaccggagtgtagcatccaaatgagataatgatggcggcaaccaaatcaaaaatcaaatatccgacatcaaatgctcctttcggatctgcttacgaagaacatgctgccatcaaggatactgcagcagaggtaagagtgcttcgcaaaagacgtctgattcaaaaagagatccgggagttatatagttagttacttgtggttttccagctccagaacaaccacttcacagctccgtaaattcaatgaatccttttcacaatctaccgttccatctatacggttcgataaccatactttttcgattttgctcttcagtttgattgttgcagcatcctttccgaaattagcagccacaagaatgcacttggattcatctttacggtaaaatgccatgactccgtccacattttcatattccggaagaaattctccataggtaaatacttctttcagttcatccgatttacgcagtgcaaccagtttgcggtaataattcaaaactgaatccggatcctgttcctgagcttccacattcacatctttaaataaaggatttacctttaaccatggagttccttttgtaaaaccgccattttccccgctcgtccattgcattggtgttcttgcattgtcacggctcatacggctgcatacttccaaggcttcctgatccgataatcccgcttcacgggcagtatgatactggtcttttgtactgatatcatcaaattcctccatgctgttccatttggcatttctcataccgatttcctgcccctggtaaatgaaaggaattcctctgaggagaaggcttatggtaccaagcatcttgattccgtccggtgtctgagcataagatggcaaaaatctggatgcccctcttggctcatcgtgattttcaatgatattcgccttaaagccatacttctgtgtttctaattgtgcctgaatgattgcagctctccatttcgcaaattccagcttcggagcatcataccatccatgttctccatcagtaagtgtatgggcgctaaaatcaaatatcgttgaaaaatgaccggtttctccaataaattccggtaattcatccggtttcatgttaaatacttctccgactgtaaaggcatcatacttttcaaaagttgattttttcagatcttccaacagctctcctactccgtctacactttcaaccatcttccagcagcttgccagaccatctttcccatccggtgcaaaatcaggaaagttcagatccttcttaatatttatgatcgcatcgattcgaaaaccggagagacctttttccagccaccagttgatcattttgtacagttcctgccgtaacttcggattttcccaatttagatccggctgttcctttgcaaacatgtgaaaataatatttgtccgttcccggtaccttttcccaacagcttcctccaaaataggaacggtaattgctcggtggattgccgttttttcccttgcggaaataaaaataatccgcaaacgctccatctggatcagcaagtgctttctgaaaccactcatgtttatcggagcaatgattaataaccagatccataataatatgcatgtctcgtttttttgcttctgccagcaattcatcaaattcttccattgttccgaattcttctgcaattgcatagtaatccgcaatatcatatccctggtctacaaatggtgatttataaataggtgataaccaaataatatcgattcctaattttttcagataatccagtttagaaataattcctctcagatctccgattccgtctccatttgtatccagaaaactctttgggtaaatctgatacgctactttgtcatgccaccactttttttccatttttatcaacctctttcatatataatcatagtatttgttcgccattgcgttattgctttagctgtattatactgctattataagatcttatttttgacaaatcttgcattattttttcattatataacacaatactgctattatagagaggagaaaaatgaaaacgccacattcacttataccggagcaaaaagaaaatatcaaacatggagaagtttattttccaatccagaagtatattacaaagctgacaaaagaagcacctgtcataacaatgcactggcacgaggaagcagagcttacacttataacaaaaggttcctgtgtctaccagatcgatttagttgaatatgaggcaagtaccggggatatcctgtttattcctcccctgctgctacattccattatcctgaaaagcagtcaggacttctgttcggaaacctatgtattccatatgaatcttttgggtggaaatactgcagacatctgttctacccgctaccttacgcccatggtaaaccacgaattatctttaccctgtctcattaccgcggatcatcctgcatatgattctctttgcaagtcttttgcacagcttgcctccctttacgatacccggatgtttggatatgaactcgccataaaatcttatctgctgcagacactttttcttctgctccagtacagtatcacaagattctccacggaatcagactcttccgacaaattaaaaattgtacttgatcatattgatctgcattatgcagaagctctgtcggtttctgaacttgcaaagctatgttatttcagcgagtatcattttatgcgctttttcaaaaagcacatgaatatgacctgcattcagtatattaacaatatcagactggaaaaagcggtagagttatttgaacacggtaacacctccatattagaggtatctttatctgttggctttcataatctttcttatttttacagagcattcaaagcaaaataccatatgacaccactggcttttataaaaagattagaactggattctgtataagctcattccctgagcgattttatattttctttaaatcctgttattttttacgataaatccgaatcatcaaaggcgtttctaccaaaagcatggcaacccagcctgccagataggaatatggcaacgcttcaattccaaagttccacaacaaaatcataggtgctgctgcaatgactcggactgccatattggtaaaactgctcatcagtgtcaccttcaggtctccgattccacggaagaatccttgaatcgcattcgtaacagccggaagaatatacatcacggcaatcagatgcagataaatgacaccatgtcctattacttcctcatcttttacgaaaagtgccattagttctccggcaaatacctggcagatcaccataacagctgctccataaacaatttccagaatcatcccacaacgaaatccctcccgcatgcggtcattttttccggctcccttattctgcgccataagtgccgtcatggcatgggcaatattctgttccggtgtaattgcaaagtcatcaatccgattgaccaccgcaaaagctgcagccacggaaactcccatagtattaaccagcgcctggatcgcaatttttcccatttgcacggtggcctgctgcatggcggatgcccatccgtaagcaattgttttcttcagcaaacgtgaatcgaataccagccatttcttacccagacgaagaatcggtacttttttctgtatataaataatacagaacaggcagcacagtgcctcactaagcactgttgaaatggcgcatccattgcttcctgcctttagtacaatgacaaaaaacagatctccgaatatattcaggactgcgctgataattaagaaatacaaaggcgatgcactgtctcccaaagctcttaaggtactggaaaaaaagttatacaaaaaggtgaacattaatcccagaaaaataatccgtaaatactgccgcgtcatctccataatcgatgcatctacctgcagcagatgcaggatcggtacagcaaataccacgcaaagtaaagtcagaaaaaatgaaaaaactactcccgacaacatcgttgtactgatctgcctgtgcaaagtcttataatcctttgccccatactgaattcccatgaggatacttgcccccatacataatccatttaaaaacagtatcataagcgtactgatcggattacagataccaactgccgccagcgcttctttccccacaaaatgccctacgatgatgctgtccaccgcattataagtcagctgaaacagatttcccaaaacaagcggcacagtgaaattcacaagaatcggcatgattttcccggttgtcagatcttttgtcatctcattcctctccttcggtaaaatttaaaattaattctcttccgttttctttcttttcctttcagaaacccttggcactgactgaagagtaatagatggaatttttaaacccattattcccttcagaatccaggtaaatgataacatgaccagaaccggaatggcacaggttgtcacaagcagcactgccacgccctctataattctgtttaatccctcctcaaaaacagagagtttttctgtagcgacttcacctaccgcatcaatcgcatcatcaaccttatccttcgcattattaagaaattcactgaaagaaaattttttatctttcgtttcttgtgcttcatccttcttgtctgcgtttacagaggtatctccctcatctaataattcttccgtatcttccagtgtaaaatcagcttcataggactttgcataggtttcatttaccatattggtcacccatgcactggtaggaaccagtccccacaaaagaacacccagaatgatactcttgattcctattctgtagataaattctttccatccgtttttcaaaaagttgcctgctgccagaagcacgcatccaataggaaataagattttaaatgcaatatacccggtgatagtcagtaaatatttttcaacaatgatcactgcataaacgatcaccatatagcctgcgacatctgccagcttattcgcgatcggagttgcggcttctcccggtattgctgcagcacctgttgcaagagcggttgctgttccggaaagcccaagtgcttttttctgcaatccattcagtgttttgataacccaacggtacgattcgacagaagttgcccatttggaaacaacaaaaaatgatataagagcaatcccaatgcagatcagcatcatgatcagacgatttcgcatcggttgcttatagtttctaactgtgatttcatggctgtctgccatcataggttctttcatacttattttcctttcatgctatctattctcggataaagaaaggatcggatacacgctcccgatcctttccaccttttcagttttctatttgtccaaaaccgcaacctgaattgtctttactgcttcctccatacatttgatgtcctcggcacgcaacctaatatccaagcactttacagtatcttccacactggaagcttttcgcattccaaccagaagactcatccggtcgtactgagataatgcccaggcttctaccagcgttgcaaaactgcaatgatattcctcacaaagtggtttccagatttcaaaagccttgcgaagtccttcttttttctccggatctgtccaaggtattctggatcggatatcggtttttgcaaattcacggtccataaaggcaggagaagttaaaaatccttcctccagcacaccataggtctgaaataccgtgttatactttttacacagatcaaaatattctctgccatggaaaggagagagaatactgaaaaattcctgtacaacagatacgtttccgccggcttcctgatatgcagacagatctgccggctgactgttagaaagtccataggtacggatctttccttcacgaaccagattctccaaagctccaaccgtttcctccaccggaaagctgccgcatacataatgtacgataacagaatccagataatcggttcccattctgcgcagagagtcttccacgtcctttttcactgctgatgcgcgggtgtcattgttaacggtataaccgtctcgttcgtaatggaaattaccgccctcatttctccagttcagagagcatttggtctgcaaaacaaaatcatttcttctgcctttcagtgccttaccaagcagttcctcacttactcctgtgccatacaccggtgcggtatcgatgtaatttacaccatattcatgacaaatatcaagcagactcttcgcgtcctcaactgtagaatctccgtctgtccagacacttccgccgccaagcccccaagtacctaatgcaaccacagaaacatcgatgtccgtgttgccaagcttttgaaatttcattttaattcctccgtttttcgttattctttcctgctttttatgcagtatcctaaccgtacagcgttcccctgacaaagctgtctatatttaaaaagacaattttgtcacatctgtgcattacttactctacctattagtatataccacgctccggaataagtaaaataaaatcactttaccatttcaaaagccacatgaattcatcaaaccggaatcaattaataaccccaactgattatttcccaattctttttatcttttgttttcactaaatgccactgccagttggtatatgtagcattaggattgacctcaccatctccacctttttcgtctgtatcaaaggttaataatactacaataagttcttgattattttctttccaatccattacttcttagttataaaatgtgaacgcatgcgttcactattccaactgctgttcaaccaaaactttttccattatacagtgcaaaataaaagagacttcactcaccatgaatgaagcctcctcaaaatacaatactgtgaatgattcacagaacatattttatcgcaaagcttttaaaaatagaatagattttaccaaacgacagttttcaaaaaagcttgcaaatatgcacgctcttgttgttgcacttttcttcagattgtctacaaacatctgataagctttttgaacataaattcaaacactgcctctttcgtcggaatcgcagggattccacctctcttttgcacacacaatccagcaactgcatttcccaaaacagcacactttttgatttcttcccattccattttttcaacattcttattcatagaaaggagactgcataatacgcctccccaaaatgaatcacctgccccagtcgtgtcgaccgcatgtatctgaaatgctttgatgatttcttttctgctttttgttgccataagaacgccctgttctcccaatgtaatggcaaccagctttggtcccatggcaaggagttgatctgcagcctgctcataacttttcgcctctgtcaacagagtactctcttcatccgataccttcatgacatctaccaattctatgacagatctcatttttttcactgcatgctctttgctcttccaaagagacgggcgataatttggatcataggaaataagtgcacccgctgcttttgccatttttaccgcttcaatcgttgtactttctgccggttcatctgtcagcgataatgatccaaaatgaaaaattctacaacctgaaattaatgtctgatccagttcttctttttttaactgtgtatctgcacccggttttcttgcaaaagaaaaattccgttctccattttcaccgatttccacaaatgccaacgttgtaaaataacccgagtcttcaacaatagcatctgtattgattccttccttttgcaatgtcttctttaaaaatttaccatgcatatcgtttccaacttttccaataaaagatgtgcgatacccaaagtggcttgcaacagttagaagatttgccggagcaccgccgggattctgttcgaacaattttctcccatcctgactgtgtcctgcttccgtaaaatcaatcaacaattcacccaatgccacgatatcaactttttcttccatttttcagttcctccacaatctcgttataacgctttttatttaaccggtagaaaaataatacaaccgcagtcacaatccacagtacacctggaatcgtcgtaaatgcatgtttcataattgaaagtacaattgcattttgtgtctgatttgcaatataaccatattttccaagtaatcctgctaaaagtgctgttccaactgccattccgattttatttccaagtgaaataaatgcatactgaaaaccatcatttctaagtccggttttccactccccatattccacacagtctggaataattgcatagattgcggtattaaatccagagaaaaaaaactgtgtgagaccagataatgcataaaaaatagccggtgattctttggcattgaagaaaaacatagacaacatggaaattcctgtaaataaagcaaagagagatgctgttcttcctttgttattcaacttgcggaataatggttgaaaacaggctgccccgatgatagaaggaataatgatgcacatcgaataagttgtgtagtaggaggcattcccttccacatatgtaaaataatacagaatatctgcgtttctaccatataatgtaaatccaaataatatctgtcctaccaatgcaagaagatatggtctattctgcatgactgctttcaactgaacctttacagaaattttttctttttccggagtgatcactgcctctttcgtcttcgcaaagcagaagaaatgacaggctgtaaaaatacatccatatatgatcgcaaccgtcagatatcctgtctttgcactatgactgccgaatttgctgagcagtggaactgtgataatatttaacacaccaattgcaatcatcgctgcaaccgaacgggatgtatttatttttgcacgttcatcaatatcctgtgtcatagcaccacacaaggttccatatggaatattcacacaggtataccccaaaaccagcagacaatatgtaattaccatataaatgatctttccattctgcgaccagtcgggtcttgcccagaatgtcataacaagaagaatcgctgtaattggtgccgctactaacagccatggacggtaccgtccccatctcgattttgttttatccgtaagtcccccgacgattggatcattgattgcatcccagaatcttgaaaaaagcataagtgctgacacagccgccatactgattccgaacacgtctgtataaaatatcatcagaaaattactgacgaacatccagctgaaattacatccaacatcgccaaacccatatgcaatcttactgatcagcggtacttttccatttttgttttcgcttcccatatgttcctcctatttttatcagagtttctgacagaactctatcctttcctcatttggtcccttaatcataaaaaacttcacaccattttcccaaaatggtagttcttcgattccgtctgtaataattgtgtatttttcattgcagattttctgatacatactttcaatgtcttccacatcaagtgcaacatgttggtatgcaccgtctgacattgccgcctgcccattttcaaaagtctctatacagtaattttttatctgtaaaaatgccactttttcccctgctttttcattataagactgcataatcacttcaaatccaagactcttataaaactcaactgttttctgtaaatcgtttgtcggaagcccgacatgggcaactccgacaattccatatttattttccatacgaactccttacttttcactgacgttgataattactttcatcgttgtttcgcggttatcatcaatatactggtatgctttcagataatctttaaaagcaaatgtctttgagatgagcggtttcaaatgaactttgccctcatttaccaatctgattccatctatgtaatcatcatggcggtacatcatcgtgctcttaatgtcaagttcgtggtcatttgccactgcaagatctacttctgccattcctgcaaaaacagccaccagtacaatcgtgcttccttttcttgcatatttaattgcctgtcccattgtgatattgtttccggcacagtcgtagatcacatccgccttgtccggtccaaatgcttcgagcattgccgcaccgaagtctttattttgggtattcacacacacatcaattccacattcttttgcctttgccagtctaagatcactgatatctgtgatcatcactttcgctgcccccattccttttgctgcctgtgccacaagatttccaatcggtcctgctccaaggactgcaatattcatgccagccacatcgcccatctgttttacaccatgaactgccactgcaagaggttcgatcatagcgccttcttcataggacatatcttctggaatagatgttactttagatgcatccactgcaaaatactcagatgctgttcctgtcgtctgaaatcccattacttttaattcctcacagagattatactttccatgacgacatggatagcaatgtccacaatatacctgaggctctatcgtcaccttctgtcccacatgaaactctgtgacatttttgccaagttctgtaatctcaccggaaacctcatgtccctgtgttaccggatattttgtaaacggatgttttccatgataaacatgaatatctgatccacaaacaccaatattcataatctttaccaaaacctgattttcctttacctccggaaccggaacctctctgaaaataatttctcctggatttgtcattacctgctgtaacataattgtttcctccttttcatgttgttttattttgtgttttataaaatgttttatcaaagtaattatattatcaccatgtaaacacaatttgtcaatatgttttttcatatttttatatatttcataatttcaaaatatattttttgtatatttttcacaattaacacgcaaaaaaacggaaaggaaaccgtagttactgttttctttccgttttttactataatatctttttttaattttacacaacttctcgtttttcacacatataaagcggacatccggattcgctttgcaacctgtcagtgggagcttttaactccaacagactaaacatccccttaccctacgcaccagatgcggtgtactgcttatcttcgttcaaaaaatttacaattctaccatatgttttgtaaaaaagtatttcgcggctccaacagccgacgcttctttcttatacgaacaatttttcaagtatgaaacatcatgctcaaagccattatatgccatcactttttctcccagtggtatcatataatctgacaatacacctcccacatcacctcctagtatgatatccatatcatatgccatccgcagatttgatatcaaaacagcaagatgatccagatactcattccatgtctgcaaatttttttcatcaccactttcaattttttccataaatgcatccagtgactgcctgttatcttgtgtcagtacacttgcagcacaatatgcatctgcacatcctgatttaccacaataacactttcttccaccgggaacgagtatcatgtgaccaaactcccctgctttctggttttgccctcgaaacaggtttccatctatgcagaatgcacctcctaaggtgtggttcaaagacagatatatcgcatttggatacttttgctttttttctgcaagcattgcagcattagcatcgttttcaaaatatactggagtttccagagcctgctctaaaaagcgcagactataattctctatacctaaagcatgggattttaaaacgatccgttctttctgatcaataattcctggaatcgccactccaatcccaagtagcgtgtccttcgctacttcgccttcaagaaaagttttgaccttttgtgccacctctgtacaataagataattcagccgtaaattttaaacggatgcgatctttttttataatctcatctccaagatttactaataccatttctatatgattcgctgtaatcaaaattcccattgcatgacaatatgacttattaatccctatactttttgccttccttccaccggttgaggcatattccccagtttcttccaacacccttttttctaataagtcatttacatttgctaatacagtcggcatactcaagtttaactcttttgcgattcccgccttggatgtaacatgattgtttagaacataattaattattttttttcttgttgtattttttttatctttattttccgttttcttaccctcttttattaaatatattataaaagaattatatgcttttttattcttcttgtaaagtaatgttttataataaatctccgacaaaatttatcttataaacagccaaaaactcccgaaggagctttccacgctttagatatacaccaattcttttaacacaatctcttctgcaatattacgaataccatttaccaatcagccagcttttatcctagtttggacaataaaacacaagtctcaacggtgctttcgttgtcccaacaaagttcctgtgtttccctgtctccaaaatacaccggaaaacggaactttatgtgcttcaggaatctgccatctggctgctcctgctcgtaaatgtccacctgttccacaaagctgttaagaaattctttcttctccaggtcggtgaacttatcatatagtttatcaaaatataaaagaaattgatagacgttttcttctgatattttctgttgctgaatattcagcaggcgattctttgcttcctctatactgttctccacgccttcaatctcatcatacaaacggtataaccttgtctccatatcctgatatttcttctcataaaatttatccataatatccagactgtccatctgctgtccaagtcttgcttttgctccggtcaactgcctgtgctgcttttccaatccttcaatctctttttctatttcttctgtatctattcttgaaccgattttattcagtattgcttcctcaaactttggattcttcaccagcttccgaataacttcttccactgcattgttaatcttctcctcactccattgtttacgatatccacatttatgaccatctaccaggcgacgatgtttgcaggcataatagaaataatccttatataaggttccgtctttctttttctttcggttcacgttcccatacataccgcttccacataacggacacctcaatattccagataagatatgttcatgatcaagactatgtgtcttttcatatttcacacctgttttttctcgtttttgatgagcaagctcccagtctgtttctgagatgattccttcatggataccatcgtgcagcatataattttcctgctttacaatgcgatattcatttcttgtaccagaaactttctcgttcttccttcgtccataagccaactttccgcagtataccggattatccagaacgccttttataaatgatgcggcaaatgcgtccagtgtattattctgtcgttttttctttttatatccatgctggttcagccatgcagcaatcgcagagattcccatattggtatgaataaatttatcatagatcagacgaataatttccgcttcatcctctgcaatctgcaattctccatttaccaattcatagccatatggagcaaatccaccgttccattttccttcccttgctttctgcttacgtccctccattgtttgcacaaggatattctcccgttcgatctctgctactgcagataaaacagaaatcatcagctttccgctatcttttgagctgtcaattccatcttctacacagatcagattcactccaaaatcctgcatcctctgcaaagaatttaaaacatctgccgcattacgaccgaatctggaaagcttgaacaccagtacaaactgaacctcatctgttccattctcaatattatccaacattctctgaaattccggtctgccctctacgctctttccagatttaccttcatcggaatactcatttacgatttccatgttctgaaattccgcatatctcttgagtttttctttctgagcatccagactgtagccatccacctgcatggttgtggatactctggtatagatatcacattttatctttttattcacttttcctcctctcctcagaacatcccaaagcaatttccaacaattctgttgcaacttgtgaatttctgatacgcattaagttatcccagacatcagcttttccaagtagattcatcccgccatgccatactatttcatcatcaataacggcaaaacattcttctacttctgttcttgttatcacatttattcctaccaattgcattgctctgattaattcataacataaatctgactttccgtaagtaatatcttccggatttgttgtaataactgtgacctttacccctacttcctgtctcttcttgactagtaataaaaatctgtcaattttatcctgtctgatatccggactggaaattaccaccattttttctgactctacaatatcttgctcgaatttttcggtataatttacagaatcaaatattgcatttattatttgtttaggttgcaactcttgcgtccagattgaaaatcccatcttcctatatgttctcaatctttttgcatacattttatcaaaataacgcacatgcgaatcgatataatcatacacataaacggcttcttttccgacataatctctgtttaatctacctacatactgttccaggcgtccttcaaaagatacaggtgctgcaagcattaatacatccagtcttgggaaatcaaacccttctcctattttctgaccagttgccaccaaaataagcgattcattttcaggtatctgctttaattttactcttatttcagcattttccttatccgaattatccccatacaaaaggaatacatgatctgctttttcctttaaggcatcatgtaaaaattttgcatgttccttaaatcttgtcaaaattacaggagtttgttttcttgcaacacaagttataacatcatctatgatcatttcattgcgcaccttactggtactaatcaaattatatgctttattgatattatccttgctttctgcagtatcaactactcttgtgtatcttgggacaaaataatgtccaatcccttgctccttagccctctccaacgcagtaaatctatgtcgcaaaggtcccagcagcatatagataatccgatcaagactgtcgccacgtttaggcgtagcagaaacaccatatacgtattttgcatttattttctgcaataattccatagatgtgttagaagctgcgtgatgacattcatccataattaccattccataagaattaatccgttcattaaattttcctctgctgtacattgaaccaaccattgcaacatctatgatccctgtcaacgtatttttatttccgtgcaaaatacctatcacactatttctttttttctttcttcctgtttttgtttcatattccggtggttcttctcttatctctaagaaatgattcaattcatcaacccactgattaagcaaatctttactttgcagcaaaataagcgtatttacttttcgctctgcaattaggtaactacatactacagtctttccaaatgcagttgccgcactcagaaccccatctgaatgtgataataatttttctgctgctaattcctgttgcattcgcaaatcacctttaaaagatactctgataggttgtcctgtttctctttgatctgaaacatcaactgaaatgcctgctttttcacattcctgtataatattttcccgcagtcctctcggaatctgtatatatccatctatatccttacctaaatatacagcactgaaattataataattagaatatcccagccttttatttttgtaaaattccggattatcaaatgccgccaaactacgaatctgattttgtattcttggcataagattcagagtatcaatataaactccattgcccaataccatgtgaagcttgcccacaacatctgacttacaaaactcacatttcttcttccatggtttcggtctgacattcttctcaatattagtaagcgttcctctgacttctgctaattctccctgccattttgccatgcattgttcaacatcttctattcccagctttcttgttttattgaaaagagcatcccattgatcaggatatgcattccaattttcatctacaaaagcactatttccatttttaagtgcctgcccctgtaatggcaatgcaatcaaattacctatgctgcttgccacatcctgcgaaggatacattctatcataataatgaaacgatttcagattgatggaagttgaacccttgtctaacaggagaaatccaaaattccttgctgttgccgcaggtattgctttttttaagaaaatccatacatgggcaccttttccagatcgagatctctcaactaaaggtctgataccattaagctcacacatttttctaagcgcatccacttctttatgccactcattatccgtatttgcaaagtccgtaacctctgctcctttttcgtgattgtcaaaatcaaatacaataaatctgcatgtaccatttggcagtaaaggatatacacctattacatctgatccatcttcttttgtgcctaacaaatgatcaattatttttttaacatccaaactaatccatttggtattttcacattcatcacacaataccttctctttacgttgtttagggcaaagccggtcattccaacgattcgcacattgtggaaaatagcccccgttctttcctcttctggcatatacatcttctcttccccaaaacatcgaaaagaaacgtattgccattttctctgtaatatacggtggatttacaatacgattcccttgatccaggtcatattcttctgcactttctattttttcttcaaaaggattcacctcttcataggaaatgcctgctttcttcaatttatcttttaatatcttgttctcatattcaagcaacctaaccatctttctcaatgaatccgcatcatatgcttctatgttcaaaccttccacctacaattcttatcatttcgtaatataacctttattttgtgtcccaactttattttagtacttgttccaactatttccaatacttatttttcctattgacgcatttctctgtcaatcgtataattaatacacaaaaaacccgaaaagaggaggtgttcgtatggctacttcaagtattactcataattttgtcatatccaatccaaacagcgtaaaactttttattgcagcgattgacgaagccgaccgtgaccgcacaccaaagcagacacttcccggacgtcagttgacaaacccacaagaaatcttatctttaatgtcaaaaaggaaaaaacaaactcttaaatattaaaattcttcaataaaaaatcctctaagacaataggtgtttcactatctcttagaggatatttctttaatttaaatggtatctggtaatatttttccaatttttcgggaaacccattttattcaataattcaacttcacttatatgctctacttctctgtttacccggtcaatctcttttatgagctttcttttaaattccagaaaatcttttccaggtaatagatatctaaacgcaatcaccacagcaaacaaatcttgttttcctttttcgtactgattaccgctctgtggtaatgaaagttttttatgaagcggtgtatccgcaatagcatctactgttctgtatgtaaatagtcgttccccatgggcacatacattcctatacttagtgagaacagatagaaactgttccatctgatgctgattcaaaggttcaaagttttttgatacttttgattttaaggactgcggaaacactcggaacatttttgataagtttccaaacgtaagtacatttgccaaaacccataatggaatttcaccatatgtcttgcggtaataattgatatatgtataatctgtggtcgttgttgcccgtttcaaggtcgctatcaactttacgattgttgcatgatttctttttgtattattataattattagcatccaggtactgcttctgctctgctccatacatttcagtaaaatagtatgacatcaaagaacgcatctgtcgctcaatctgcagtaaatatttaaagaacaactctctaagctctgcatcaaacttatacaaactgactatttcttcaaaacttgttcctgctttatatttttttgtgtttgatattctaaaaagatgtttatatcctcccataagaggaaaatatcctatttggcgtaacatctcttccgcatattctctgtcttttatttttattcccttttcatcactgatccaggaaacctggtcactaaaagaagagaattttttcggtgtctgcatctcatttctccttaaaacaaaagagggagagacccgcaggctctcccccgcctgtaggcttctcaagtttctacagaacgatcactgagcttagtatacgtcattttaaatgtcctgtcaatatgccaaaacattctctgtcatatcagctcaaaattattctatgctatttttctccaaattatcattcttttttatcagcttttaaaatttatttgatttaaaaatacatgaaaaagcgacagtctgatttacattttgtatttcaggaaactgccgcttctttttcttccttattctatttttcttcctccaactcccggaggacttcttcgccgtacttatcaatcatccgtaccagaaaatcaatgcaccgctcaaattcaatattctgttgcataagctcctcccgttattgtttgttctgagcttattttacagaacctgcctgaaaaccacattgaatagaaattgattgtaaattgacacaatcactttaaaaatatccgtattttcttgaatcgaatgtacgttcgtgttatgatagatatactcaatcttaactacgaaaggggaatttctattgaatcgatgcgatttttcttctattagcacttgcttaaaaaatcatatcagcgaaagtaatcaaatgagtcagcctgattttttatacgaattatttgaagattttatggatgatccggcaatcttcatcaggatattactgacatggattttattgacaatccgccggaaagcactgaccaggaacggtttcaaagacataaccattttctgcgttccctgaaatctgatactctgcttatcatagataattttaatgtcactgccacacaggacagctttctgtcagtagtattaaaatatcgctgccagattttgtttacaaccagaagcaaactggatgaataccgtaaaaagaaatagaggatatgaacgctctcttccatctggcatcagtattttattcagaggcagacacgtaccggccaacagttgaaaagatcatcgaaactgttcactctcatacttttgccgtggaactggcagcaaaacttctggaaaatggaatctcaactccagaccagttattaacaagacttcagatggaaaaagcatctttccataacgaagataaaattaaaataatccaagatggacaaagcagcaaagccacctattacagtcatatccatacgctgttttctttatacactttatctcttgaacagcaggatatcatgtgtaatatgtgctttcttccttccaccggtatttctgcccgtatatttgccaaatggctggaactgcccacactaaatgaaatcaacgatttaattgagactggtttcgttcagacaacaacacgtcgcactatctctctgcatccgatgattcaagaaatcaccctttcatagacaaaaccatctgtaactcgctgccacatattactggattttcaggcaactcttgaaaccaaacctgaaaaaacaataaaactggaaaaagatgcgcttcatataaatgacagcatacctaagattgccaattatgcaatgttcctgacagaacagcaggaacccgaaagaggcatctccgaattgcaaaaattatccggcatcatcaaagaataccattccgatgactgtctggattatgccaaagtacaggaaacccttggaaccattgatctgatgactgccaatcttccgcaagccaaaacacattttaaaagagctttcaaaatatatgaaaagatctgggctgatgaaccagaaatgattaaagcaaaatatcaggaaattcaggaattatatccacagattgggttttgcattggaaaaaatctatccggtcttttaaaaaaataagcataatttacggcgggcaacttgcccgccgttatattcaactattcgtcaaataaatatatgcatcttccaaagtgatatcattatccaggacacaattctcatttggctttcctttgcttaatactttcatatgaattccattttctacatactgcttagatgatatagagtaattggcttctaacaaacgggcttcttctgcattttgtaccgtacaattccaaacacagccctttgcattttccagcaacccactcacgcttccggaatataaaaaacttccttttttcataatggcaagctgtgtacaggttgctgctaaatcttctactacatgagtggaaaacagcacagttctatcctttgaaaaatcaaccaaaagattgcggatcctgattctttcttccggatctaacccggtggtaggttcatcaataatcaaaaaatccggattattaagaagtgcctgtatgagtccgacacgtctcttcataccaccagataattgccgcatttttttattctgatgctctgtaagagaagtcttttccaaataataggtaattctttgtttgaggtcatttgtggatactcctgatagtccacccatatatacaaggcattctttcaccgtaagattcggatataagtcgatttcctgtggaagataaccaatctttttctgtattttttcataatttccctcgttatacagaattccatcaagcgaaaccaatccttccgtttgttttaaaacagttgtaagaaccctcatcaaagtggtttttccagcaccattctcacccaaaagtccgtaaattcccttaggtatttcaagagatgccttatttactgcaactacaccatttttaaatctaactgttaaatcatttattctaatactcataatctatcctcttttctttaaagccattggtaatactgcaaataaaaacagccccgctataaaagacacaagcgttccataaatccaactctcggacattaattgagtaggttcacaaaagctgaaagaaaacaatcccagatttccgaaaaatgaacttcccgcttttgatataagtccaatgacaattccaaataaacatccaatacctgcccacatatttcgaagcaatgtacacaaaatcacagagcatatactccaaagccagatagttccaaacattgcaatgaaatataaaagaaatatctgaatacccgaaatgccttcgtttacactgcccggtttttgccagaaaaataaaacatatccaacacaggaaagtattaataaatataatatttgaacgcacactctctttgatattacttttaactgctttttttgatcatacaaatgaaatacatcggcacgcttactttttacttccatcaaatatgtgtcactacaaaaaataattgttaaaaatgctattggcgactgaatcgctgaaccgatttcttcatagtatataatcggatgaatagcacacaatatcagtataaatgcacatgaataaaaaatcttatataacgacagacagtttttgagttccgttttcaatgaaccctcctccttttccagattgtaacagaaatacatactaatataacagatgagatcacaagcataatctgatttatatttgacattttggctacatgtgtttcaaaaaatctgccagggaatcgcaccataatagagaacggtctcatataataaatatcattcttcatggtcagcatatttgaatatataatgtgtaaaaacaagattggtgctgccggaagcggatttttaaatattactgctgtaattgtatagacacaacatatcatcaaaagattcggaacaatatagatcagagaattcacgcaaaaatcaattggtgttactggaaagcccgattctaaagacgttttcaaacacagcataaagaatataacattcaaaatcactaatactcccagcatactaatgaatccgcttattactttcccacatatatattggattgccgtaacaggctttgtatgtaataattcataggtactttttcgtgtatcctgaataaataaaaatgatagcaagactgttgcaaaaaaggccatatgcaatcctgcaaaatccgtaaatttttttgcaaagtaccaggaaaaagaatgttcggataatttctgttcgatataatgattgatttcttctgctgtccccttatgaatttcaaggtcctcataagcatatattgcattataatagccatattgggattccaaaaactcagaagcagtctttacatccatattctgaatttctttcattacatgatctgcttcctgcctgctaaatccaaaaccatttttggaggtgtccattaacgtctctttgatcgtatcttcccactcccttcttctttctttatcatcagatgtgggaatgtacccatccatgacatcagcatcttccaatgctacgtcattttgtgtgatctgttcattctgtttgatataatgaatttgcaaatacgatgacagacattgatacatactggcaactataataatcaagccaatccacaaaacagggttctttaaataatcaagtatacttctttttatgattgttttcattgtatctcttccattctttatttctttaacaacatcatacaaatcaattctcaataaattcacaacaaaaaagactaaaaccactttatttgtgatttcagccttataaagtatttttattcagctttgaaaagagcttctacatgagcaccgccttgtctggcattatatattttcaaatttcctccatgcttttcacagaaaatacgagaaatatacataccaaggccaaaatgctttaaatcatcttgtggattcttatgataaaatggctctgttactttttcctcagtatccacaaatcctattccatcatcttcaacagaaattataagaaaaccatcctttttctttatctgcaaagcaatacttttttgtgcatatcgaaccgcattttccagtaagttgtctgtcacttccatgacaagttcctcatccactttcacaatgttttgttcctgcactctttctaccttacataatttactttccttcttggacagcatggcagcttctgcctcaatcttttttgccagttccgataactctatctctgagcattgcagttccctctgttctaaatgggacatttttctcatgttttccgtgaaatgctctatacggtcaatctgatacatgcctgtttgtaagatatcaataacatcctctgtttttatactctcggcagaaacaaactctaagagcatttcctgatacccacgcaatatggaaagtggagaacgtatatcatgtgcaattgcattccgcaaagccttctcgtcatcaatcattcgccacatctttctgttgttatctgctaaatcacttcgcatcatttcaaattctttacacaaagttcccatctcatctttattttcataggacacatgaaaatccagttcattatctgcaatcatttgtgaggcatcttttagttcctgtagaggtgtctttaacttatttttataaaaaaagaataccgcaacaacactcccaacaatcgaaaaaatcagtaccgaatatgtttccataaagtcacacaattccgaaagatgatagtccaaacgattcatctgcgattgattaggtcttgatatctcaatctcgtatttctttccatattgctgaaacacgtccgtataatctgcataatcaatatatttttcccatattttattctgcatatttcctgcaaaatgaactgtaaatccagataacagaaatgctgccgttaagctgatcacaaaataaagcagaattgtttttttcagtgacaagtttcttattttttccatcggtatccaatcccccatacagtttctatgtattctttttctgaataatccgctatttttttccttatacgccgtactaattccgttatcgttctactgtccccttccgcatcatatccacagacttgtgcatatatacgttctttatcaaacacctgccctggatgcatggataagaattcaataatctgatattcaatttttgtgaactccatcctgtgtccagctatagctactattttttcagaataatcaatcagcatttcatccatgaaacggtattccgttttttgttgatgcctttcttctctctttatgtttgtgacaatccttgcttccaactcccgaagactaaatggtttcgtaatatagtcatccccacccgaaagcaacccattaattttatcatcttcatcaactcttgctgttagaaacaaaatcgggcataacactttactgcgtatcagacgacatacttcaatcccatccatacgtggcatgttgatatccaataaaataatatccggtttcatttttattttatttaatgcttccattccatctgtagccgtaatggtttcatattgtttcatattaaaataactacaaagcattttcaccaattctttatcatcatcaacaactaaaatcttgtatttcatccaaaccacctccagtatccatattatacgataaaaaacaatgaaatcacaacaagagtacatgaagaacgtaagcacaatatgactggatgaatcattttaatccaatactgaataaatacaacactgttaaaaagaaactcaaagctaaagttacggaacggaaagagtagctaatcttccaggcagaatgctctaccgataaagatatgacgaatctatccaagaaatacggccagatgaataacaatcttgatatcctggattctcaggacatctcgctcaaaaaacagcttgaaaaagatgccgccgctttccgggaagaaaaatttcgtcctgaaccagaacaatataccgagttactggataccagaatccagatacgtcctgatttccgggataagctgattgaacagctcaaggggactttcggtaaatattatgactatcaccgtcgtaatattgcagccgataaggtggattatctcaatgtggaagatcctgatgtcttctcccatcgtgcatgggaacttgaatatcagaggaaacaggaagttagaagaaatcaacctactcgaactaagaaaaggtcacatgatatggaattataattttctttaaaaagaggcgcatggaccagcaaatccatacgcctaattgataccttgtttctattccttgcgaattctttcaacaacactttcccgactcatcttttcaaactgatactttggtatcacatacgcaatcccaaccaaaattggaatcatacgcacacatggcactatcgtaagatgcagccggaagaaaaatgccgtaccaagcgtatttattaaaatctgctttgctccaaccacaactaacaatactgcaatcataaatgcgcctcccaaatataggaatccctcagccactagcattttcgatatctgttttttcgtcattccaacaacttccaaaagtgccagttctttttttctgctaattacagaagttgctgttgtattaaagaaattcataatgccaataaaggctaaaataacgacaagaaaaccaccgatcatataatatttgctgacaaactgctgaaaactctcctccatatccaatacagaaaaaacatttatcatatcattttctttcaaaacatttttatcaatgtattcttttacttgcttatcctctcccttctttgcatcaatggcagcatacattgctgattgattttctgtctgggtgatatactcttcttctgggaccattactgtaatataaacagaatctgcatacggataatccagggaatatggcatcatagcttctccgatcaccccataatctttctgctttccgtttccgtactccattttaaaagtttcgccagactgataataagaaactggttgttctgtatatttatcactataatccacaatcacataatccccacttttaaacgtatcccaggaacatttttcccctttccattctaacatatcaaacaccgcttcactaattccgaggaaatgaacctttacagtattatccgcttttgtttcctcccagatttgcttttcataatctgtccagttttctttgtttttttctgccaatgtctcccacgttttcaaaagtgccggttccatcttatgtctttcttccgaataatacacatatcctgttttctcactttccggacacttattcagaatctctttgatttcaggtgtaataccgttgaaatttgtattcgataaagtgtcggtcatctgatccagttgaaaatcggaagctaaaaacacttttcggtaagaatcaaaatcatatccctgcaccaacatcacgatacagttgacaaccaccatagaaagagcgatagaaagcataacaatcaatccctttttccaatttcgtaacacattttgaactgccatcccccaccaggttacagaagtattcttttttattttcctatgtgactgctctccttctgccaaacgcagagcttccacaggcgaaactctttccaccattttacaagcctgcaaactggagagatacaccgttaaaagcgttaaaagtatcgctgcaaggaaaatcaaaggatttgctgatactactgtctgagccgtttttcctgcctgtgcactaatttgggcatctgcagtcaaggacggaaccatacaaagacctgcaagataaccgaagatcaatccgattggaatccccactgctgacaatttccatgcctgcatacgtacaatttttttcaattgttttcctgttgttcccacgttcttcaataatccgtaagctctaatatccgttttcacggatatattaaaaatattataaataattaagtaaccagccaatatcacaaacagtaccattacaataagggaagtgaatgaaaatgaatcctcttcaaaaagattatatgccggattgatctccaatcctgtccctgttttcgtaaatcctgctgtcttagatatattttctgttttcttttccagattccaaagattcttgtaccagacagaatactcctttcccccattatagataccattttctaattctttctgtgtaacaggataacaattctccttcgcataggcttcagatacccagaccatctgacctaaaacagccttatcaccctgccaaaatccacatatctggaatgtatctgttttgtattgtttcagcattggatttacttcccacgtcagcgtgacttcttccccaatctttggtgtaactcccagtgcttccagtaccaagctgctgactgctacttcattttccttctctggcagtcttcctgtaattggcagacaattaaagctttctgccatatttttatctgcatatctaacttctactgaaaagccaaaatgtttatctcttcctgctcccagaaaaatgcctgttccatatcgttccacctcatcactttgttctattgttttttgcaatctctccgcatcttcttctgacaaattctgcgcaatagcatgggatgaatccataaattgcttaatttccgttgctcttttggaaagtatcatggatacgctccccacaaagaggcttgtaaataacagtgatgtcaacatgattgcaataacagcaataatatttcttgctcggttcattttcataaaacgtttcgtcaataatcgtaacgtttctttattctctacttttaccatataatcgccctcactataccaaaccactgtctgaaacagtttttccgtcttcaatctgtaaaatcctgtcagccatctgggcaatctcctcattgtgagtaatcattacaatcgtttgatgaaaacgcttactggtaacttttaaaagtcccaatacatcctgactcgttttggagtccagattgcctgtcggttcatctgccagtaaaatagcaggttttgccgctaatgctcttgcgattgccaccctttgctgctgaccccctgacagtgcacttggaagattttccagttttgtccgaatacccagtgtatctatgatttcatttacataacctttttcaatcttttttccatccagttttacaggaagaacaatattttcccatacattcagcatcggaaccagattatactgttgaaatacaaatccaatatttctacgcctaaaaatagtaagctcttcatctggcatatggcttaaattctgtccgtcaacaatgacctgaccggatgttggattatccaaaccaccaatgatatgaagcaatgtagactttccacttccagaggttccaacaatcgctacaaactcccctttttctacttccaggtttataccatcaagagccctgacttttgtttctccctgcccatatatttttcgtaaatttactgcttttaatatattcatgccatcctcccatcaaaaaagcctgtattgatctttacaatacagactttatcataacaatgtctccatctggtttctgaaatgtcacagttttgatactattccttctttgctatcggaaggaacacagaaaatgtagaaccctttcctctctttgatgtcacttttatataccccttttgtgcctgaatgatctctcttgcaaggaataagccaattcctactcctggctggtctgccactgacagactccgataaaaccttccaaatatctttggtatttcttctttttctattccaatgccatcatcaatgatatcaatctttacaaaaaaagaatactgctcgacttttatctgaacatttcccccacatgctgtgtatttaatcgcattgtctacaatatttccgagtgcctccacggtccattttgcatcacatcgaacatgcaaatccgtgtcacataggctcagagtaatattcttctcccttacttttgcgttaaactgctgctgtatagattcaagcatctgcttaatagtagtatcctccgaatgtactgcgataattccactctccatccgtgataatttgaccaatgattgtatcaaaaaatctaatttctctgtttgctccaaaatggtagctatctcctcctgattttcattactcacttcagagagtatttctccatagattttcagatttgaaataggagtcagtgtctgatgcgcaatatctgaaataagtttttgtatcacttctttctgttcctgttgattttttcctgccagaaagctactgtctatatattgtttcatgctgttttcaagagcagaatacttttcttctgatacttctgtccgttccagttctccatctattgcacaatccagcatttgctgcagccggttcaaaagctttttttctttctgataaaaaaagctgtaccaaaaaactccgctcaggacaaatataactacaatcaacataattgtttctatcatccattcaccgcccatgtataaccaattccataaaccgtcttgatatattcaggcttctgcgtatcatcttctaatttgtctctgaggcgtttgactgcaacagtcagagcatgagcatccacaaactctgtatctccctgccatacctcgtcaatcagatattcccgtttcactacttttcctctgttttcacacagcactctaaggagcttttgttctgtcttactaagttcaataggttctccatctttgaaaaattccattttatcgaaatagaactcaaatccatcaagctccatagaatttttagctgctgcctctttatttctaagctgcacagacactcttgcacgcaaaaccatcaagctaaacggtttcgtaatataatcatttgccccagcttccaatcctgttacaatatctacttccatgttatttactgtaagcagaataatcggcacctgactgtttttccttatttctcttacaaaatcaatcccattcccatccggcaagttcacatctaacaaaaccaatgtgatatcttcctttttcaagatctctctagcctcctgcaaggttctgcactgataaaagaaataagcatcattctttaaagccagacggattccatcatttaattttttgtcatcttcaacaatcagtaacttttcactcatattttctctgctttctttcaaattacgctaattgtatcattgccagttttataaatcaaatcattaaatcaaaatctccggcagaatttatcttataaacagcaaaaaactcccgaaggagctttccacgttttaaatgtacactaattctcttaacacaatctcttctgctacatttcggatattatttacagctctgacccattccatctgatcacgagctttcaattcttccgtaatgccctgcctctccatcatctgacgcaccagaatatccattctctcctgtgcttcatcgtccacagtattcagatgttctgtcaatctgtcttccaacatatacagtgaatacattgccggacgatgctctttcagatatgttttccgcatcattccatatttcccataatgcggttcttcatctgtactgacaagattcggatagtaaattccgtctgcgccaagtgtgtaggttccacccattttttcaaatgtacttttcacgtgttattcctccttgaaatcagcgatgtccttagatcatcgcaaagtatttcagggcagctttgatagcatcttctttctctttcgggcattgtggaactcttgcattttctgattttggaatattatagttttctcccacttcaattccacatttgcgttttacctgagaaatatataaatttgaaaccttcaagccaaattctttcagcacataatctttgatttcctgataggttgctttcaactcggcactagtggcatccagctcgtccagatctaagtcgatctctatcgtgtcatctggcttctgttgggaaaaaagaacaaccgtctcgatatggcacgataccttctgattgatgtcaggttctgttcccgttcgcggaaacatatccggtcaaagcggaaacatgtccacacattctgaaatcgcatattcacagctgcagccagatgcaatctgtggcaaaattgacatccatatccagatcttggccatcgaagtctatgggagcaattcagcatgcgctctaattgctcatcgaaatacttttccgtcagatacgttccacgcttcagccgttcatcatccataacccagcctttgatggtgtagtctttagcaatctggtttacccatttacggaactgtaccgcacgctcggaattgaccttgaagcctacagcaatgatcatttgaaggctatagtgcttggtatcgcgtgtgacctgacgagaaccttcggtttgaactatccggaaattccggatagttgaatcttcctcaagctctgaatcagaataaatcttcttgatatgctcattgattgtacaaacatccacatcatacaaggtggccatcatcttctgtgtcagccatatattttcatcctcgtagcgcatgcggtgaaatgttccgcagaattcactggaacaatcgcggttgcaaatccatcgtctggcgctgcatcagtagactggagccaaccgggcaggaatgccacgcaagaactgtcaatgagacagtattggagaatgtggtagttcaggccatcaacacgctccttggtgatacgtccacctaccaggcacagctccaacagaacatcgcaaaggtgatccgtagtgctcagcaaaaaaccgctgatggcattgacgaaagactgcaggagcttcagaaagagcttctcaaaaaagccaataacaaagaggcctatgatgagattgccgacgagatcttcaaactccgggaacagcgagaaaaatgtacggttgacactgccgccagagacgcacagatttcccgcatcaacgaactgcaggacttcatcaagcaagcagtccgcacacctggacgccttcgacgaggtcctggtaaaacgctggcttgagcgaatcatcgtccgggaggaccacttcactgtggaacttaagtccggactgaaaattgatattgaaggataatcccctagacgtacgaaaccctctcgaccatgatggccgggagggttgtttgttattctgctttactcacaggtaaataataaatctttccatcttttgaaatgagctgtacatcctctgcatacaactcagatttatctattttatgtgtacaaacatggcctgccttctgtgctgtgatcatacttgcagttttttcttctattcctcggaagtttaaattatcattaaacaatcctggaataaaatgaattactccatcaaagcctgctctctttcttcgtgactcatcagcctctattcctaatcggtcagcagtaccttcatgccaagcaataagtcgtgtctgtgtatctgatacctgtttcgagtatgtaggtaataatgccatacactgttctctcgaaactgtgccaagatgcaaagtatatctcaaatcagaaatcttatataagatttccagaagcgattgttgatacataaaccaattttgtgcatttcctaaagctttttcataaccatcgtaattaaggcctgatttctttgcaaatccagccaaagtaagattagcttgtcctagaagcttagtacactcttcctctaagctatcaagctgagcaatcttcgaaagtcgaagctcatcattttccaaaatctccgtctgaaaatcagcaatctttttaacatgagctaccagcgaaaataccctacttcgatattcattatcctgaaaattctgtatctgagagataccatcactgattactccaagctctgcattaatctgcgtcatgtaatactgcccaacaatcattgatgctacacccattgctgcggctgctgtatttgctgctactgctgttcctttttgtgcttcaacagctacaagatttgcgtgacctctaattccatcagctccatgataaaaacctcgaactgctccttccatcgctttcgaatctgttaacttagcacccgctggaattatggctcgatacaaaacctcaccatttgccttgacagcctgtgtggcattattggccgcatttccagcctgtgccagtcccggaacaagattatttatatgggcaagcaccttactatccgtaatctcaacaagtttagtttcatccgaaatcgcatctgcaggaagtattcctatctgaataaccagatcatttgcaacttcagatgcttgcaatttactgcttgatgttttacttacaacaactgctgtattacccagctcatttttggttcgtttgttttttacgtatagcacaatacctcctgctattgcaaccacaatgcacgcaccaattattacatattccatttatcgtaatacctcctatcgtttattcataaaaggctttgctattttcgcgaattatagaattctgtaatcttcaattgcccccactggatgagctgttgttttatcaaacaaaactatattcttaccagtcttagatactgtactaccataaattattcccgcgtatcctaacgaaatataatactgcgccatagtttgaaaaggtgcatacattaaacttttattatccttttcatcaagcggttcaaatatctgttctgaaagtaattttgaatacgtatatactccccatttagtaaatagcttcttaaattcttctacattcacgttgttccttggaataaagcctaatactttagatttttttatacttttcttagcctgttcttgaccataagtctccaagccatcattcagagctttatatgtcatttcatccgctattgttaaatctactaccttaagtgctgtgctatcagcggcaaattgaaaatgacaaaaaccaaatctatcattttgtttaactcgacattcggcctgtgcacattcatgtatcgccgcctctttgcctattgctaaatacaaccattctatccctgaaggactaaatctgttatcttcctttataaattctgtcttcggaataaaacgttcaaaatcaggattctcatcttctccaagaatagtacctctgccgacacaatatttctcaatctcagatattaagactgtattatattctattccagcattcttattaaacaagtcatcataaactctcaagaacgtattcttctttgctgaagcaatatcatcaaaagaaaaatctccttttgaaagtgcatctctaaactcttgccacgtcttcttaattgatttttcacttttttcaataccgctaaaatcaaatatctgccccaaaacatctatcccccttacatctattccactgcctacaaccacccaaaatggtcgagttgccggattggttgtcaccctttttcattttccaaaaatcatcccaaaatgcctgacatctaatccactgtctcaaatcgtgacatctaatccgaggttacaacctgacatacattttgcagtagatatgtttccatataagaaaaccgagctttttcaaaagtctggcttcaaatccaaaccttacaaaaagcccggaaatacgccacttttcagcctttatttatcttttcttgacagcaaacagaccgtctcaacggtattccctttgtcccacaaaagctccgtaacttccccgccatccttgaacaccggaaaattcagaccaatccgctttagcggatattcagactcgtcattcctgtaaatttcaatttccttaatcaaggctgtgaccacatttctcttttcttcgtcatttattatattataaacgcagtcgaaattcaccatgattttgtaaatattctcaagagtaattgcctgctgcttaattgcatctcgccgaagtctggcatcttcgattttttcctccagctcaacaatgacatcatatagggaatctaaccgcaaggtcatatcatggagctttcgttcccggtattttgcatcagcagggagactgtcaatttcccgttccaatcttgtcttattcagatcaacttccttcagctttgcctgatagccctccagttctttatccactgctttcgtgtcaatctgaacgccaatccgttttttaatggcttgggcatattcctcatttcttacgatctcacgaattgcctcaatgaccatcggttcaatatcggtctttttcagcattgccttatattcacaatgcttaccccggaccatcctattccgactacatacataatagtaaatttctttgtaagtgccatctttatttgtccatgcgtgtttattcgtatacatgggacttccacaaaccgggcatttcagcagaccggataacaaatgaactcgatcccgcccaatttttgacggttgctttactccggttctaaggcgcttggcatgagccttttcccatacctcctcactaacgattcctttatgctgtccctctgtcagaatgtaatcgtcatttcttttcatctggtaatcgttttttgtgcctttgactttttccttcgttctccgtccataggcaattttaccgcaataaaccgggttatccaatatcagtttaataaaatgtcctgtccaatcctctaatgtgccattctgcctcggaattttccgtataccttgtaagttcaactgattcgcaataccacccaaaccgatttccgatgaagtatataattcaaaaatcttccgtattgccacagcctctgtttcttcaatcatcagcttgttatcttccagtgtatatccgtatggagcaaagccaccattccatccaccttgccgtgccttttcgcgccgcccgttcatcgtctgctcgataatattctcacgctcaatctcagccacagcagatagtacagaaatcaaaagttttccgcttgtctgagaggaatcaatcccttcttctatgcaaatcagatttacaccataagattgaaccaactccaaagagttaagtatatccgctgcattacggccaaaccgtgacagcttatacactaaaatatagtcaatgtccaagccatcctcaatatctctgagcattttttgaaaggcaggccgtccctcaatggatttaccggatttaccggcatcttcataagtatcaacaacgatcatttcctcacgatccgcaaatcgtgtcagcatatttttttgaccttccaggctgtatccgtccacttgcatctctgtgctgaccctcggatacaaaacacagcgttttccatatcggttcataattcatacctccaaaatttacttttggaaaatatcctatgtaaagctgcgattctcacgcagctccgtcaacctcgcccagcactctcataccatatttctcgatgatatgtgccagcgaagtgataaacgcttcaaatttttgttccgccagaagttcttctgaccggatttcatctgaaggaatcaatgcgcttttattctggatattctccattcagaatcacctccgcaattcctaacgaaattataactctacttgcacagcctgaaaatgatacggcctttcggcacttttatgtaatccccagactgcacaagagcgtcttgtttatgttttccatgtcatccttgtttagatgaccaatatagttttttaacctcgacttgtcgattgttctgatctgttccagcataacaacagatggtttcaccaaaccgcatctgtcatttaagtggtaatgcgtggggaactttctgctttttttgcttacactggtgattgctgcaataataatcgtaggactgaaacaatttcccacattgttttgaagaatgagtacaagacgagagccactttgttcagagccgataccagggcttaaatcagccgaatatatgtcgcctcgatggaatttttcaaacatcactctcgcctccttaatatcttaatacttaaacagccgcaccagtctgaaagaaatctccggataaaaacctggtgcggctactgttattctgttcggattactcgtcatatttgccacgccccctgacgatgggaacacaacaggtctccgctggcgcagctgtcataactccgcagcatcgttcgtatcgtgtgccgcagggttccccccaagtctttggcgggccgtgaggaagtatctttaagcccccatgcagtcatcgcgccgaatctgccaccatccgttttgtggaatcgtagatcgctccaaagcagctttgttcatcacctccctgactgctctatcttcgcggcgttccacactcgctcgtacacgggttatgtacctgttatgctgtctatgaaattgtcaaagtgctgttgaagggggaaaacttgtccttcttattaactctgacaaaaagagcaaaaaacgagcgcaccaaacgaaattttatcaaaaatattttgccagctgtttcagccctcgccgaatgctgtcacggacacggcttgggtctacaccctctgctgcggctatctctcctactctcatgcccagataatacctggcatagatccgcttggcttgtttctccggcagagccattactgcggcatagagtttctcccgcagctgcttttcctccaggagcatttccggcgtctggggcttcatcaggatcgcattttcaatgccattgtcgcagtccagagagtaatgcgccttataacgatacatccttcggtcataggcagcttctgcacgctcagagtctctgatcgtctccagcacatcttcggttacttctacaaagtgatctgttttataaacatcgggatacagatcccggagattgactttcttcattatgtacctccatttcggttcacgggtccagttacgagtgagccgaaatggggcggagaacggcaccggcataattcggggcaattccacaaaaaacaacaagcaaaaacgccagtctcccaaagtgggaaactggcgtcacactgattccatgttctatgattaccgattaaccagcaggataatgccggtggaggagcgtaaggggatgaggtgtgagcaaggctttttttgatgaactacatattgctactctcatggcggctccctccgtgggccgccgatcctgcgccgggaaaagaaaagcggcggccttgattgttcaaagccgccgctggtcgtatgggcgtgtcaaaagggctgctgtacgacggcttttttttcttggtcgtcgcccggcagttgattatgttgattacatagagagaaagatagctattccacaaaaaacagaatccgccgaatcagttccgggatattaaccggggccgtgatatagtcgctgacaccctcgtgccggtattgatattccgtggcaaggtcagtgcttgccgtaagaataaagaatggtagcaacttaatgggcgggttatttaccttaaatttttcagatatacgtcgtatgtcatgaaaaagctcaagggctgtaccgtccggcagcgagagatcacacagtatcagttctatttctttatcttcaagtagcctgtgctttgcttcacgcagggaatttaccagtataagattaaatcccttttgcagcatagccgcccgcagaacttccgctttgctattatccgtatggagatataacagcttatgaaaggttggtggttgttcttctgatagctccttgtaggcatattccaccagcttatctttcaataatgcagatttaattttatccatacagattgtgacaccatgctggagtgcttcctgctcatagtcgtctttttcataacaagacgcaatgataaaaggagtatctttgttacaggtacgtacttcagctagtagttccagaccagaaccgtccggcaagcagaggtctgaacagatcagcagcggagcttcttgctttatcatttcccgtgcttcagccagagtagccgcagtttctaccgcatagccccgccgctgtaaatattttttcaatccccatataaaagttatatcattgtcaaccaaaagtatctttcgcatctgttttcactttcttgtattctgttagtcacgcattctttcgactaacgattgtttatgaatatagcgatttacaaatacagtaattgcaatttgtccgatgactactgcaactatcaaaacaagcgtttgggtaatcggatattcgtattgactaatcgttagaatttgggtgtttataataatgcgtaccaataaataccccagcccatttccgatggttagtgacagtgctaatgttccaaaagtaaagaacagtccttcccgatgtatcatttgacgtagttgcttatcagacaaaccgattgcttgcaaaattcccaattcctttttgcgaactaaaatactcgtaatcattgtattgataaggctgatgtaaccaatgattccaatgactatcagtaatccgtaaattgtgtattgtatcgtgcggattagctgctttgcgattccaagttcttcgtcataggatttgaacatgaacctcgtattttcctgttgcagtgtatcaatttgtgcctttacactttcaaatttttctggctgaacagtaatgtaaatggcactcgcaggatttgtctccgtaattagttgctgtaaaacctcatcggcaatcaaaaaggtatcatcactgctgttggtacttgccatgagagtacccgtaaaaggaattttcttgtttccatcataaagtgtaagctgtattgtatctccaatttcaaaaccatattgctcaaacaaaatgtcccatgtaaaaataatgccgttagaatgaaccaattcatcataatccaaggttcctctttttagcgatttatttagggataacagatcgttttcgctgattcctccaacctcagttcgctgtgtttccaataccacattttcagcttctgccagaaccgtgtgcttttcatcaatgctttcaacaccatctaaagacatgatttgcgttttcagatcatcgttcaagggattttgaagctgaattatatttagattattctccgggtactctcgatcgtcctcagcataattaaggctaatttcaaaatcgccttttggcatcagcattcttgcataattttccgcagttatattgtttgcaatattggctactactaaaaacaaaatgccggaacagcccagtgcaagtatcgtgaccgcagttcttcgcttatttctttgtagatttgcataacttagctttgatacggaaagtgttttaaaggattttttccttttttgttttcctgtcggttcttgataccgcattgcttccacaggagaaatccctgacgccatttttaacggttttcggatagaaaccccaactgtaagcaaaacaaccacgataacacaaatagcagcctgccagtgccagaatgtatccccaaaggtagaaccggaaagaataaccattctgaacaagaatacggttgcgaggtatccaagtaagattccacagggaattccgacgaaagactgtgcaaggctttctgtaaatagcaagcggcgaatatgttttttggtagcaccaagagcctttagtttccccatctcttgtatattggaaatgacagaaacataataaatgctgtaaattaccatgccaccaagaaatactaccaacagtccaagcccgatcataacatttcgttcttgtgttccggggttggtcatatatgtcaggtattgttcattaaaagaaatgtctgacttgttcagtcctacgtcctctgcaatctcagatataattgtctcaatttcatcttttgaatgtttattttcgtttacaatccgtatataagctgtataagttctatcctctggggcaatatgttgttcaacaaatttttcagatacaaaagccccatagacaagacgtgtttcattcacattcagctttgaaatgtctgtctgctctaaaataccagtaattgtgaagtcgtagttctccactttgcctccctgaatgcgtaatggaatctgaaacttctggccgatttctggtacaacgtctaatctttcaaagagcgcaggaggccctgcaatttcatccgcttccacaggcatctttccattggctaactgaatttggtcaatagaacctttttttgtggaatcaaaattaagaacagcatttaatttcggcagttctatggacgctacactttcccttgtagaaagcgattctacatccgcgtgattttcaagaataaatacctgatctgcagtactgcctttgaaagccgcatgataatttcgagcactttcttttatctctaactgctgatgtcgaataaccgtaagtgcagagctaccaatagacatgagcagtgttgtcataagagcaatcgcaactatggtaagaatggatcttcctttattatatttcaatcggctgatagccaaatgataaattgttttcattgttccaccaccttaccatctgtaattaccagttttcgatttcccatttgtgcaatatcttcattatgagtaattacaatgagcgtctgctcatacttcatagcagatgttttcaaaagtgccattacttcatcacttgtcttagaatcaagatttccagtcggctcatctgccaatacaatggcaggcttcgtcgccaatgctctggcaatcgctactctctgttgctgacccccagacaatgtgttaggaagattattcagtttctcgctcaatccaagtaattcaataatttctttcagataaaccatatccggctttctatcatctaatccgataggcaaaataatgttctcccagacattcaaagagggaacaagattaaatgcctgaaaaatgaagccgatttttctcctgcgaaatgcggataaatcttcttcattcatattggttatacactcattatcaatccagacttcgccagaagtgggataatccagtcctccgattagatgaagcaacgtactttttcccgatccagacttacctacgatagttacaaaatcgcctctctcaacacaaatagaggtatggtctactgcgttaatatgattaccgcctgccttatacgttttggtcaggtcttttgtttcaagaataatatccatcttaatactcctttgccaatacggggtaacttgttctgtttaagtgcatcatcagccaatgttctgcctcatagctctttttcaagtatgcgtaactctctaaaatctggttggcgatactcttttcatcatataaaagggcagtggtacgagcggaacttctcatttttataagtacagcaggatttttcaaaattgaaatcaagttgtccgcccattcagttatggaatctgacgacaatacaccattttctccattaacaacaacatctgatactccggttgcacgaatagcaaagactggtagatacgctgccattgcctctaaaagcacaattccctgtgtctcagattttgatgaaaacagaaacaaatcacacgcctgatgatatgctgaaattttatgatttgatacttctccaatgaaaaatacattttcttcaatttttagagtttgagacagggctattaaattttctttctctggcccatctcccaaaataagcacattaaaaacatctcctaactgctttttcacagcagaaacacctcgtagtaggaaagaaagatttttttctttcgctaatctcgaaaccgtacagaacaaatactgtttcttctgcaaatactttttccggatggcagttgcctcgatatgattttcaaagcaagccggaggcagtcccgtaggtgcaatgctgatcggtgtatctatgtggaatggtttcaaataattttgtatagattctgttggtgcaaaaaccatatcacatttttcaaggaagcgattcaaatagcgttgtatgacttgccgctgtgcaaaatcaaggatggattcccccaatagatttccctgatttgccttattttgtaaataaccaaagggcgtcaaataatgcagatattgttcatatcttgtgtggtatgtaaacactacggggatatgaaattcctttccaatccgtgttgccacatttccgatcataacgggatgatgaacatgaatcaaatcaatatcaagtgttgaaatagcattcttcacatagccataaatcaaattgggaataggaatcgctccggcgatcttgtgtttcattgttggaaagcgaaacgtatattcatcatcatccaccggagatttataatccggggcaaagacgtataccgaatgccctaaatccctcagactatcagcaagccgctcaatcgaaattggaacaccgccaacaaatggtttgtagttatttgtcatcatagcaatccgcattttctcacccccttgtgattattttcagtataggttctccaataatatagccagcgcccacgaatagggtattccaaagtgttacccccaaaaatgaagcaatcgagtattttataaactccatttttaatacgcctgctggtatagaaatcaatgttctaaccatcggaattagcttactgatgaaaattccataaaaacccttgcgtcggattaaatcaaacgtgcgttcaaacgcaggtttgtgtttgggaaacctttttaagtatattttgagaaaagcattcccaccgtacattcccagaaaatacaatatccagctcccaacttctcctgctaaaacagaaatagcaatagctgcaaggagacttatccccccgtgtgctgcatagattcctgcaagcggcataataatccctgctgggaatccgggaagattcatatattccagtagtacaacaatgaagatagccattcctccatacaattcaaagtaattatttagtgacgatatatccatcttttcctcccgtaccttaactatgattattgtatcaaagaagtattacgggaaccttacagaatagcttaccgttgaataacaaaaggccggaatttctccggcctcttatcagttcctaaattgtagaataaatgtacttcctttttccggaacagattcgacacggatcaaacctccctgtcgttctaaaatcattcgtgtcagatataacccaacaccgctgccttccgtttgctttacataagaatgattggaacgatagaaccgctgaaaaattttattgtattcattctgtggaataccaatcccttcatccttaattttcacgagtgtataaaagtgttgtttttcaatagaaatcgtgatgtggctatttcgaggactatactttaccgcattatccaaaacatttatgactgcttcgcttgtccaatgcttgtctaaatgtaatgtaatattttctgtttcctgcacggaaatttcgatgctttttctccttgctttttcgtatacaccatttacagcatccaccaatagatcacttaacaaaatggattccttagtcaaagaaatcatggctgtttccaaccgtgaaatattcataaggcttgcaattaactgttccagtttttccaactgcgtttcacttcgttttagaaattcggtcttttcatccgcatcagaggcatccaaatacatatagaagcaggttttcaatgcagccattggtgtttttaactggtgagaaatatcagtcacaagtgcttttgtgctttctttttcctcagtaatccgggtgtttttcgttacaatctgatgtccgagttgctttaagcgatcaccaatttgattgctcataaagtgaatacggccttttacgattctctctgttccataggcaaaagaaaaatcctctgacaaatattgttccaatatcagcaatatttctttattgctactacggatagtgctgtaaaaatagagaagtgcggccgcaagaagtaaaaatgtggtaaccagaaaaaatcctgtccaatttctccatgcaatcatgtaagcggcatacagcgtgttgtctgccaataaatgttcttcgtcatatccgtattgcttcaaaatctgttcgcctttttcctgcaaagagtttgtaggctgacgcaatcccagaatgaaatcctgctctacatcaggataattttcaagtaccgcgccacatatttgttgtacggttaccaattcctgtctacctgcttcttgcaacatatcatgttcaattttaggtaacacaataatttctgctataaatatgctaattataataagcaatacaatttttagtagtgtgaaagtcctgttatttaatgtcattgcctttcacactccatttcccagacgtaccccaagccccgtacattcttgatgtagacaggattagatggatcaggctcaatcttttctctaaggcgacgaatattaacagcaacagcattttcatcaacataatccgtattggaatcccataaacgttccagaagttgttttcttgaaagaatatggtggggatgctcaataaaagccatcaatagtttccagtctgtcggtgtaattgaaattgcattatcacctttcacaacacgcttttcatctatataaaatgtcaatttgcctgtttgcacaatattagaaacagccttttctgttcgtttcagcatggcacttatttttgagacaagaacagacatactaaacggctttgtcacataatcatcagctcccatttcgtatcctgttatcacatcgacttctgtatcaagagccgtgagaaacaaaaatagcacatcacttcgctgtcgaatattagcacataaatctaatccactaccgtctggtaagcctatatcgcaaatcacaagatcaatcgtattatcttgaaatagtttcaatccttcagaaacgcaagccgcagaaaaaactgcataaccctccttcttgagtttgaggcttataccacggttaagattttcttcatcttcaattaacagtatatttttcatattttaccctttccttgttttgttctcatatctactggcttttcggcgtccttggggagcagccagacaccggccatttttacagcgccgggaatacgaccaccggcgcaataatagtttatctgtcggacagaaacgccccatttttcgcttgtttcttttagagtcatataatccatctctgtacctcctgcaatctattctattatatttctattgctcgaagaaaacaagcctataaccatgctgttagaataaaaatcggtataatcgtactggcagaccggaatgataaggttattcctcaaatcaaaccggaacgatacaatattattgaggtgaacgataatgccgattgatgatttgaccgccttgggcgatgcgctccgagcagcacgaaaagaaaaaaatctgacgcaggaacagctggcagatgaatcccatgtttctaccaaacagattgccgatatagagaaagccaggagaaatccttcctatctgatcttgaaagcattggcaaaggtggttcatctttcactagactcgcttatgtacccggatctctcgccggacgaagcaggacaaaatgagatgaagctactttacatgaactgtccgccagagatgcgtgaaacattgttgcaccacactcgtggatttgcagaggaactaaaggaactcgccaagaaacttgaagcaaagtaggccagtgagcgaaatttgaaggtttcgtcactggcttattttatttctgcgggaaagaggcaagcaatgcctgtgttaatacacacaggcccgcagagaagaaaatccatccgtgattttcctctccgcttgcttgttgagggcagcgcccccaagcccctttgaacacagaatttcattctgtggctgcgcgttctgcgaacgcttttgaccaggaccagcttaccgctggccgtggtctttttctttttcaacatcctgttctacctccattttcagcactcgatctacatttgcctttgccgttaaaagctcccgcatttcctcacgggagcgccgatactcggaataagtctttttcttttcttccagcaattttgcgtactctgtctgtaactctttgacctttggcagcttcttgacgcccatctcatcaaaggcattcttagcagcctggtggagcagaatttcttcctcatgttcctcccggaatttcttagagtaacccgccttgcggtatgccacatagacctcacgggtcttggcataatttacgatgtgagtacgcagaacagcaatctctgccatgcgcttttcagccgctttgatctgcgccgaaagttcattgtgatgtgccgtggcagccgcagcctttttttccaaaaccgcatactccagcagattgttctctgacaggtaattcatggtctgcgccatttgtttcagattaaaaactttagcccatcgagcatagccagcaccttttccagcctgcaattttgcctgaatgtccaccagcagattgatcttcggcggctctgcctgtgtgactgttttctttcgcggggtatgtgctttcttccctaagagaactgcccgcaaatcttccaatccatatccttcgcccagactgtccatgcgggcggctttctcccaaccagagagtttcagtcgatacgattttccgcgctttgagacttcacaaccatattctcgcaacagcttcagcagttcttcaaagtcagcaggactttgtgataatgcgttgtcaatcgccacacgaagcagctctcggtgagatggctttgcctgatcgcccagccatttgttatagctctttccgtgaagtttcggattctctacaatggacagtccattctcaatacagatggtgtcacttagccgacgaaccgccttggtgctgccccaaaagtttcggaacttccggtcatattctaagctgaccgatgaccagataatgtgattatgaatgtgcgacttgtctatgtgcgtgcataccacaaaagcatgattgcctttggtaaaacgccttgcaaattctacgcccagccggtttgcttcttcttgggtaatctcaccggggcggaaggactggcgcacatgataggcaatcacatcatccgcgccacgcactcgtccggtagcggcaatgtactgccgctttgccagaagaaactctgcatccgcagtccggctgtcacacgcatagctggtaatgagcttgccgtcatctgttttctgtggatttgctacatagtcgatgatgtcactgatcgcccgactctctgtgcggcctttgccgacatgaagcggcatgattcttgtagttgccataaaaagccctcctctcaaaatattttctctgaactctttgtgcctatcgttgaaataaactctccttatgggtataatataaagaaactaccaatacctcaaaggagggattttatgatagaacagctcattgctgaagcaaccgaatgtgatttcaaagttgcacttgaaataaagaaacccaaaagctggttaaaaagtgtcagtgccttttccaatggaatcggcggcactctgtttttcggggtctctgatgaccggaagcctatcggcttgtctgatgttcaaaaggatgctgaagcgatcagccgcttaatcaaagaacgtatcacaccattaccgcagtttatcttaaagccattgcaggaagatggtaaaaatctattagctctggaggtttctcccggccgcagcaccccatattattacaaggcagacggcgtaatggaagcatatatccgtgttggaaatgaaagcgtaattgcccctgattacattgtgaatgaactgatcttaaagggaaccaatcagtcctttgataccctaacaacagacgcggtaaaaaaggattacagctttacacttctggaagcaacctatctggaacggaccggtctccgctttgagccatccgattatgtctcattcggtttggctgacaaaaatgggttcctgaccaatgccggaaagctcatgaccgatcagcacacagtttataactcccgtatgttctgtacccggtggaatggcttggaaaaaggctctatctttgatgatgcgctggacgataaggaatacgaggggaatttgatttatttactgaaaagcggcagtgaatttattcgcaataattccaaagtccgttttgtcaaagaagctcagtatcgggtagacaagccggattatgctgaacgagctgtaacagaggctcttgtcaacgctctcatccatcgtgattatattgtgcttggcagcgaagtccacattgatatgtttgatgatcgggtggaaatcacatctccgggcggtatgtttggcggcggctcaattcaggaatacgatatttacagtattcgttcgatgcgacgaaaccctgtgatcgctgacctgttccaccgcatgaagtacatggaacgccgtggaagtggtctgcgcaaaatcgtcagtgaaactgaaaagctgcctggatacacagaggcatataagcccgaattttcctcaacagcgacagatttcagagtcatcttgaaaaatgtaaactacaacttagaggatgacacccaccaagttatccaccaagttacccaccaagatattgaactatcaacggtgtccaaacagattttggctttttgcacaacaccaaaatccaagaaagagcttgcagtattttgcggcttcaaagatttaagaaacttcactttgaagcatatcaatccgcttttagaatccgggcaattagaaatgacgattcccgataaacctaaaagtcgcaatcaaaaatatattacagttcgttccgaataaacagagaagcagggcattgggtctcatctcccattgtcctgcttctttttcattccaaattatattcacatcatttacccatacacccaatcctgtatcgcaaatttcaaactctgcacctttcccagcagccagatcgcagccagcggcagccccatcgggctaatcaaaaatgccataaccagcaaaatcacaccattctgcggggaataggtaatcagcacagccacgccaagcagagcaattaccgtgcttagtagaccaagcaccaaaccggatatgtagatcagccccgtgcagagccagacaaaaagcgtcaacaccaaaatgaccggtgcagttacgatcatcagcaggcatttcaaaatcttcatttctgttcctccttccaacgctccagatactgtttgcatagggcatccgcttctctctcatcatcttccgtcacttcccgttttcctttggtcagttcaatctccagataagtccggtaatcatcggctaagaggtcgagcagttccttgggagtatggcacacctcgccagagcaatagtgaaaatcttggtcaaattcaactcttacacatccatggcggctgatataaacttctatggtctcgtctgcggttaggtaatccgcaaaaatctccagcaccttttcaaaggtcagcatctgttttcactcctttgctacgcttcttattctactcatattatccggtacgggcagacaaaagacaaggatacagacaaaaagaaaaagcggagggaagtgcggcgaagaaacgccgttcctccctccgcaaatggagtatctatccctgttatgaaagtttggagagttgggtaaggatttccttcacaccctcccacagttgttcctgccgctgggatatatcctccaagtcagcattataaacccgcccggtctcatgcactttgcgggtcagctggttcaagttgttgctgcttcggcgcatcagggagaccaactccttcagctctggcagttccagcttgaccacataaccatccagcgccattttccgcagataagcgctcaaattctctgtcccgtattgctgcatcttttgatggatcagttccagttcttctgcggacacccaaaacaaaaccggcacatcccgcttgcgctttgccatggttatcgctccggctcccgttttttcggggcggcagacttatgggcgggcagctcctgtttgagcttatcccgtactgagggacgggacggttccagtttttttctctgggtacggctgcgctgctgttcttcacgcaccagatcaataaaaccatccagcacagcagggtggctgtttaaggcataaccacaacggacgatttcgggattattgttgggaatggtcttggcccattctttgttgcgtcgggagtaacgcccatcccagtcctgaagctggaccgtgttagacagaaccatggacacacgctccatgccataggtctcgatcacaccctttgccgcatcgtggctgagatacattccgtcgaagtgctcccgcaccgccgcttcaatagactctttgcattggcgatttacattgttggaagctcggtactgctccagctccccatgttctctcgcataggcagctgaatggggatagatcggtgttgttcgcagttcctctttagctctgcacacatcgtcggcacggttctcaatactgtcccggatcacatccatatagccggtctccagcttttcaaaatagcggtacacatccgccaatggagagggagattccaaaagtgccttggcctgggcgtcggtcagctccagctcctccatcgccatcacaatatcctcacggacagtatattcataggtgtggtgcaggatttcttccgggggctggcttttcagccagtcccggaacttatcctgttcggcagccatcttttcataaagggctgtattcagatcgttagtattcatgttatcgcacctcctcatgctgttttggtttcttgtctgtactgcggggttgcaccgggcgttttaggttatccagcaccgaagtccgtgtgcttttggtaacaacagactcggtatgtgcctgcccctttccgtcgatgttgagcagggtatccagctccaccagacgggcgtttttgcttctcagttcttcttcataaaggaatggctttccgacttcctcctttgccgcagcctgctgctgatagaggttatccagctgggcctttgccgcctccagacgctgggtcatctgggcgagggcattgtcgatacgggtaagatttccgcgagggtctgtaccaagggttgcccggtgggtcatctgtcctttcagcaggagcgtatactcctgtttccaagcggaaaattccacggatatggcatagccccggtagctgccgatctgcaccggatctgaggttttgacctccttgcaggcatccaaaagggctgcaccggcgttctccttatcggtcagcagatcgccgcggatttccataccagcaaaaccgtcctccgggtgcgggtgcgctgccaaaacctccagatcggattcaaagcccttgataaagcctttgtgcttttcaatctcctccgggaagtatttgagcagctggtcctccagacgatattgcttgctctggtggtcggctttcatcagcttcagcttggcaacctccacatccaaatccatgcgttccttgatacgggggtctccggcacacagggccttgatctcggcaaaggaaagcgccgtttcatccacatcgtcgcagcttctcacaggcgatttcgaggtcataatctggctgatgaatttctgcttattctccactgtctgccagaggtatgcgtcgaaagttccctcggtcacatagcgatacacatggacaaggggattctggttaccctggcgctcgatacggcccttgcgctgggcaaggtctcccggtctccacggacagtccaggtcatgaagtgccaccagacggtcctgcacattggtgcctgcgcccatcttggcggtgctgcccaaaaggacacgaacctgaccggtacggactttagagaacagctcctttttccgcacttcggtattggcttcatggataaaagcgatctggtcggcaggcatcccatgggcaatgagtttctgacgaatatcatcatataccgtaaaggccggttcctgctccggcagaggcacggcgccttccagtgcatgaagcagtggattatccagcgttttcgccgccttgcttgcaggagcttttgcctgcggtgtagaaatgtcgcagaacaccagctgggtcagcttgtcagctttgccgtcccgccagatctgcatgatgttgtccacgcactgattgacctttgtgccaggttcatccggcagcatctggttgacgatcctctggtccaggcccagcttacggccatccgaggtaatcttgagcatattgtcctgggacgggtcaacggttccgctgtgtaccagcgatgcccgttccgaaagagtcttgaccatttcctgctgatgttcggtaggctgcgccacgatgttgtggtattccacctccggggtgggcaggttcagttggtcggcagtcttgatgtccgccacttctttgaacaggttcatcagctccggcaggttaaagaacttggaaaaccttgttcttgcccggtagccggttccctccggtgccagctccaatgctgtgacggtctccccaaatcgggaagcccagcagtcgaagtgggtcatgttcagttcttgcaggcgttcatactgaaggtaacgctgcatggtgtaaagctcggtcatggagttgctgaccggggtgccggtggcaaaaatcacgccacagtttccggtgatctcatccatatagcggcacttggcaaacatatcggaggatttctgcgcgtccgatgtggaaagaccagccacattccgcatttttgtgtatagaaacaggtttttatagttgtgggcctcgtccacaaacaaacggtccacacccagctgctcgaaggttaccacatcgtcttttcgcccctcggcttgcagcttttccagtctggcttccagagactttctggtacgctccagctgcttgacggtaaaacgctcgccgccacttgcctgtacctctgcaatcccctcagtgatctcgtcgatctgttcatagagaagccgttcctgacgctcccggctgatggggatacgctcaaactgactgtgtcccatgatgatggcgtcgtagtcaccggtcgcaatacgggcgcagaacttcttgcggttatgggtctcaaagtcctttttggttgtgactaagatgttggcagaaggatagaggcgcagaaactccgatgcccactgctcagtcaggtggttgggaaccacaaagagagatttctggcacaagcccaggcgtttggcttccatcgcagcggccaccatctcaaaggttttgcccgcgcctacttcgtgtgccagcagggtatttcctccatacagcacatgggcaatggcgcttttctggtgttcccgcagggtaatggccgggttcatgcccccaaaagtgatgtggctgccatcatattcgcggggacgggtagagttcatttcttcgttgtactggcgcaccaaagtctggcggcgctccgggtctctccagatccagtccctaaaggcttcccggatcgcctgctgtttttgagccgccagggtggtctccttggcgttcagtacgcggcgctcttttccgtctgcgtcctctatggtgtcatagatgcggacatcccgcaggttcaggctgtcctctaaaatcttgtaggcattggcacgactggtcccataggtggtataagctgccacatcgttgtaggatacagaagatttccccttgatctgccattcagcggtaaaggacgaatagttgacctcgatactgcgctggagataaaacggggtgttgaaggtctcatacataaactgctggatatattccttgtcaatccaggtagcgcccagacgcacctcaatctccgacgcatccaggtctttgggctgggcggcggtaagagcttccacattgactgcataaaccgggtcctgctgtgcggcccgctgcgcctgacgcagtttgcggcgtacattgccggagaggtattcatcagcagtcacataatggggcgttccgtcctgctccaactgtcccggtacacggaagatcacgccttgcagttctccggccagtgcttcttttgtttttccggtaagctggctcatatagtccatatccacgcaggctttttccgagatggacaccgccagtgcttcgcttgccgtatccaccacagccaccgcctgatggggcttgatggtccgtttggtgaacatatccgccttgcgctccagctttccgtcctcgtcaataacttccagcgcacagagcaggtaataggaagaatcatctgcataggccaggcggtttgcacggtcattgatgagaccgtatttggcagaaaaactgtcatagagccggttcagttccgcctgcttctcccgaatggtgctgtccggaaccgctgcatccatctgaaggtcgatcagttcctgcacacaatcacgcagtcccacaagaccttttacacgggcttcggcggtggcgttgaggtcagggcgcaccatacggctgttttcccggtagtacacctgcccgtctacaatggcataggaatagttcttcacattggggtcggcaggaatggaggtgtcaatagcttcgccttcgcccagctccggcagctctgcctcctgataagtgccatgaatgtacttcacagcatcatgcagctggtcggaaagctccagtccctcgatagggttcacggtgtagtccataccatgagcagtgcttaccggctcctgtctgcccagcaccatttctgggtggtcgataaaataccggttgatggcaaacccgtcctccgtctgtccggtctgggtccattccggcacgatgtccaacgggcggtcccgcttttggaggaagatgatgtccgataccacctcggcaccggcattctttttgaacgcgtcattaggcagacggatagctcccagcagctcggcacgctgggcaagatagcggcgcacggtggaatccttggcgtccatggtatatcgagaggtcacaaaagctaccacaccgccgggacgcacctgatccagtgctttggcaaaaaaatagttatgaatactgaaattcagcttgttgtaggctttgtcgttgacctgatactgaccgaaaggtacattgccgatggcaaggtcaaagaagtcacgcctatcggtggtctcaaagccgcctactgtgatgtccgccttgggatagagctgctttgcgatgcgcccggaaacagggtccagctccacgccgtacagatggctgtttcgcattttctccggcagcataccaaagaaattgcccacacccatagacggctccagaatatttccggtctcaaatcccatgcgacccacggcctcgtaaatcgctttgatgaccgttgggctggtgtagtgcgcgttgagggtggaacctctggcggcagcgtattcctccggggtcagcagcgctttcagctgggtatattccgcagcccatgcgggcttctccgggtcaaaggcgtcggcaagaccgccccagcccacataccgggataggatttcctgttgttccggcgttgcctgttcagtggtttcttccagatatttcagcagcttgattgccgcgatattggcctgaaacttggctttcggaccgccttcgcccaggtggtcgtcggtgatacggaaattctcagcggtgcggcgcaggttgtccttgtattccccgtaagcggcttcctcggcggctctggcattggggaaggtctgccactggccattgacctgaatggaaaccgggtgttcgtccagcacttcctcaaaggttttctccggctctgtcacaggcgctggtggctccggctcctcgatatgcagtcgttccaccaccacatcataaggcagattgttcttatcgcccggatagacggccatggtctcggaatggaaggtcggggattcggtagccggttggggctgttcctgtccaaaaccgtcctgctgacgggcatacatcccgcgcagcaaagacgcaacctcatcccagcggaaatacagcatagccagacgcttttcctctgcatccatgacttccagttctatgccctgtgccgtggtacggtaatcggcaatatcgccggtctccagattcagtgtctcgatctcaccggaataggctctgctcagccaataggcgatctcgctgttgctcctgccggattgcagcagcgtggaaatctgctttttatccgcttcatacatcagtccatgagccaatacatcccgcaagtcctgatctgccttgtccgggtcagtaggaagaaactcggtatagtaagcattgcggcggtctgcccgaagcagctgctcaaactgttctttgcgctctgcccggtagatgggatataccatcccggtgggcagaagctgtacggtgtcctcccgcagctcggtgatctgataggcgtcatcctcgatatacacggtatcgcccacggcatagaccggggcggctgggtcataggaggttctttgcggaattgggcggcgaactgcgtcatattcctcatcggaaatggaaacttcggaaggctgctctatctcggcagctgcgatctgctctacatccgacaccacctgttggataaacgggtcattgtccagtttttccgggtctgccacctgtccgttgacaatccctctttcctccagggcttcccggatggcgatggggtcgatgttgtcaaaacggtcctgttcttcttcggtatagaaccggtcctcctgaatgagctgggcaagcctgcgctgtaccttcggccagggcatctgcgtttcctccgggctgccggcacggacaacgaacaggctgttgctgttactgccgccgtattcctgagccagccatgcggcggtatctttttctcttgcatggtctttcatatagcggacaacagcgtgtttactctcgatattgccgttccatgcacaaagggcagtatcaatatcttcctgagaaagagggcgccgaagctcatggagctttggataggtctcgtcgatcacttcccggtgtaaacgctgacggaactccggcacatccgaatagagtcggatcagctccatatccttagaaccaaggactgcacggcgcacagcggcattgccctcgatgacagcattttcacggtcagaatgcccgcaggcattgcggtatgcggcatcctcggaaatggcggcagtcaccacagtcttatactgctcaaactgctcccgaagggtaggctttggcgtttcttcctccatctccggctgctgggcttgaatggcatcttcttcggccagttcctgttcagactggattttgtcatactgcgcctgttcctgttcggtaagatagcggtctttctggacaagtgaggtaatgcgcttggcaaccttttcccagttcaagtgaacatccgggcagtcctgctttttatagtgcagtccttttccatcgtgatcttcgccgctgtgtgttgcgccggacaaggcatgagagcgtccgccaatgccatactcatctttgaggaatcttactttctccttatccgtatggttttccatgaagaacgcatagatacggccttttcctccggcgaaactgcttccgccggtcatggcggcgtcgatctcatcctcggtaataaagtgctggacggttggcacttgggaaagctctgaagaaaaggtcctgcggggcaggtcaaggtccttcaggttctcccagatttccctcggtctatgatagcgaaaacgcaacaggtcacggtcctgctgataggcagtccagaaggcggcgtattcttccttgagggtctggcggaaagccgggtcactcagctgctccgtcaggcggcgggtctcctctgggaaaccattgcctttgatctctgacaggcaggacaaatatccggcttctctggcttcctcgctgaaatcgtggtacagataccagagcttttctgaaaggaggaagcgttcatagcctgccgcttctgcaagctccacattggaggcaaactggccgctctccaaaagctccccgatacgctctgcggcgctctcccaggaaatgacctgggcagacctgtcataacggacagacttcccatgtgaaagatggataccatcctcggcataccatgcgctcacactgccaaggccattgccgccgtggtacagcgttttcagtatctcggcaatctcagcggtggttttctgcttttcaaaggctgcaaccacacgctccctttgacggtctgtattgccgcccaaacgcagcacatggtcgatgtcattttgggcaaaagaaaaagcagaggatgtatgcgctacattctctgcttcatctatggattggatctgttccgcttcggagaggaacaggtttagggtcagctgttgataagctccgccatcaggatctcctccgcctgggctttgcaggtgttcatcagccccacccacttcatgggatcgctggctttcagttcctcggtggctcccgcttccttcgccagctggggcatcatctgctccagtctgctctgggcggtctcgtcgatctccagaaggtgcgggtacagcttctcgctcagcaacatctggttgtagaggatgggacgatgttccttcaggtaggttttcctcatcctgccgtacttgcccaggggtttctccggctgctggctcagcttcaggtcgggaatcagatagtctccgttctggatataggtcatgggattgttcatcttgtttgctcctttcttggttggcttcgcgctctgcatttcggacggtaacgccgatctgccgcagcacctgctggttgatctggctgaccgctgttcccagcgccccgatggtggacggggtgttgaaatcaaagattgccatgaaatcttcgtggtcgaagtagcgttccggctccagtccgcagcgggacatcaaagcgtaagtgatactgacggtggctgctgccttgaactgtactccgatgttaaactcatcatattcctccaaaaaggaaccgtcaacgatatagaagaagtcctgctgatgctccgtccagtattcctcagccagttttccggctacctcggtgagctgtccggcaaggtcatcaccggaaacatcataggtgcgctcaagcatggcctgcaccgaatccaaatggcgctcctccagctgccacagccagggagtgcgggaatgttcacgggttccggtgtcggaaatatcaaaaacatagcgcaggcggggcctgtccccggaatcgtccaccagagcgattcccttggagccgcgccttacataccggcccatcttttcattccacaaatcgtactctgcacaggcggtagcgtccggacgctgggcgtagatcatcaactgctcatggaacgggtacttgtaaaggcgggaagcagtggtgagaaaccctgcccattcctgccagctccccgtgagctgcgttgccaccttttccgccatctgtgcatatagttcagctttggttggcatagtgttctgtgctcctttcagttttggggtaaagaggtggggtggcatattgccaccccatccctgcgattatggtgtttactgttcaaaatccggatacagctccagctgggcaaactcggcatcactcatggtctggagcttgcccagtgcgctgtctgtcaactcccgcagctcggtttcctccggggccagctcgccgcgcatctcacgcaggctgtcgatcagtccggtgcggctgccggtattgtaaatgcacatcaggttcatttcctcaaaagtaaagtttcccatatcaaatctccctttccgcactcttttttggcgctatctttttgtgttctgccttgggctggcttttcagctgctccatgacggactttttcttttcccgttcctcccgatgggcagcggcagccagatccatcagggaaatgggctgaccgctgcgggcctgctgttccagctctgccaccgtaggctcttttgcgccattgttgatgataccgtcgatcatgccgtaatcgtcctccacggccatctccgcatttttcagcggattttccggcaggaatccggggatctgggtaaaaccaacactgtcacagtaatgacaggataccttaccatcctgcttgatcgcaacgatgtcgctgacgctcatggaggggctgtgaaagtccatgggtttttccagattgaattgctgatagagtttttccagctgctccagcacagtgccagactcactcagaggagctgtgtagattaggtcataattgctgcggtctatggaaatatcatgggactttagccagtccagattcataaagcgcacattctgcggatcgtcacggctcacctgatagatggcaaagcaatctctgttctgggatagaaatgcctgttcgcgttcctgctgatgttcctgacgctccatgaccttttcgtggaactgagggcttttctcccattcctcacggtccacgccaaaaagaccgccatgatccatgatttcctgcgggtcaaacaccatgctctccgtattgtcctcatgcagcacatagacggtcaaaccggcggcatccagttccagcgcccgttctctggtaacagggaacatcccatcataggagtagccgtattcctgcatatctgatgtggagatctgctcatccggcatggggtattcatccagtgcctgctcctgtgcttccggcagctgggaagaagcagccatctgactgacctctgcctgcatctgctggtaggcagcttcctgcaaggtctcaatcatggacaacggtgcgtattttaccgagtctctgcccaaatcgttgtcatcacaaatctggagaactgccttcatgcgggaaatctccggcatatccagctgaccaccatccagctctttcatggacgcggcatcgtaaagggtatagtcccagccgctgtcacaggattggatatgaagataggtggcatcgtcaatcagaaacaaaacctcctgctggttggcgtccgcccccagcacttccatttccggcatggccgcagccagttcctttaccgctttttgcaccagaggattatcacggtaatagtcgattgcctggatggtgtccaggtcaatggtctggccggtcaaaatcggaaaaggtccttcatagtcgcttccgtctttcagctcgaagccaatgcccttgatcccgttcattcgctctgccggaatctcctgataaatgcggacagcttcttccaaagacagattatcgtggtattctccgaggtttggaaactccatgcactctgctacatagtaggtcagattgccggtcggctgtctatcggctaccttagcagcatcttctggctgctctatcggggcggtttccggctctgcctttgcaaggggggcaatcccacgctctttgcagatttccttatagtggcgctcaatgtcagagatcaaagtaccggaggtcttgttgatggtttccaaactggttctcagctctttcagctccttgccctgactccagcttgcaatatagccgaagctgttttctccggtctcgatgccaaaatatttgcagactgcgtaggagatgctttcagcctccacttcctccgtgtggcggtctttcctctgttcttgcaaaaactgggtgagggtagaaaagccgccaacaaaattcagcccttcttcctcggtcagcatcaggcgtccatcttccgccaactccagcggctctgtcagcagaacggaacctgcatggtttacaactacttgttcttctacacagaccggctctccggggtcgtagtcagaaccgcgcaggtcatagcaataaacgccctctggcagattatcacgggcaatccgcccattggagaacagaccgggtttatcaaacagctcgatctcctgatattgctcgtcattggcaatctgaatctttttctgattgtggagcttgctgtgggcaatctcgtgtactgtggccgaaaccgtctgcacctcactcatgccctgacaaatggcgattttctgatgatcggcagaaaaatagccgtccgtatcggcggccattgcttcaaaagtgatcggcaccggcgcactgcggcgcagagcctccatgaatgcctcataatttggcacattgccggaaagggaggaagcaagctccggcaaaggtttcccgtcggtctggctcacatcaaagaccttgaccggacgaaacatggggatttcgatttctttttcctctgtgacgatctttccgtctttatccagaatcggagccttggtatccgggtccagcttctgctcctcgattttcttcttatacggtgtgggggcgatgatggtaatgccatgctcgcccttttttacatgacgctcaaactggtctttccacttattgtatccggctaccaatgtagcgtccggcttctgcatatagatgagcatggtgttgtttaccgaatagcggtggaagcgggacatgacggacagatagcgcatatacttttcactctcaaacagttccttgatcccctgctcgatgccatctgtgatttcccttagccgctctcggttggtgggtttgttctcagccatgattttcaatctcctttccaagtgtgtgatttctgctgtgtgttctgcaacccatgccctttgttcttcttcactttcataaagaaaaaggtccaacaggtactctacataggttttcttctggatcgcttccacaaagcgggggtgcggttcttcctccggtgtccggggagaatggtcaatcccccattttttcagcagatgatagtaatcggacagtacgcggtaacagcgctgtcgatcctcccgaaacttctgtgcctcggttttttgccggacatatctcctgcggggaggggcctgactgtcatagatcaggccaaagtcctgtgccagtttctccgccgcttcttttgaggagaggtcaaagagctttgcggtaaagtcgatcacatccccatcttcaccgcagccaaagcagtggaatcgctggtctaccttcatgctggggttcttatcatcgtgaaaaggacagcaggccatgccatttcgcctgacttttatcccataaaactctgccgcttctctggtgctgaccgactgcttgaccgcttcaaatacattctctgccatgtgcctttaactgccggactttttcacagggggctggtatccggcggctttcgcacgctcactggcagctttgcgacgctcggcgctgtatggctcccggactgatacacaccgcttggggacggtaaagttatgggcgtcctttcgggtgatctggtcggggtgcttttttgccagcagttccagcttctccatcagacggggatcgtgggtgtagacctcagccattggttctgcctggttatagaggagaatggtttcccgttccactaaagagagcttcatcggctgcctcctttccgctggtcaaattccagcttgaagttggcatactgtccatcgtcctccaaaaccacagcggcatcgtaggtctttccggttttctccgaatataggcccgtcacacggacacggccatcgttaagcagtgcagacaccacagccttggtcggctgttttttcttggcagcccaccatttgttatttttccagattgcaaatttgcaagaatcattctgacagaagaagcctttttgcagttctgcaacttcaccgccgcagcgagggcatttacccaccacctcacggggcggggtgaacaggtactcggttcccttgatgacctgataagtccccaccaggtctctcagcatggtgctgattccatccaaaaactcctctggggcaagctgcccgcgctcgatctcgcccagtcggtactcccactcggcagtcagaagcggcgattgcagttgttccggcagaacggtgatcagggaaactgcatcgtgggaagggagaagctgcaccgttttcctgctcttttttcgttccagaaaaccggcagataccagcttttccaaaataccggcacgggtggccggtgtccccagaccttttcgctcggcatcctccggcatatcctcttttccggcagtctccatcgcggacaacagggtgtcctccgtaaagtgctggggcggactgcttttgccttctttgacgattgcagcagcaaccgcaagggtctgtccttcggtcagctccggcagggctttctctgcgccatcttttttcggctctgcatccttcattttggcacggtaagcgtcctccagcgctttccatccggggtgcttcaccgtttttcctttggcggtaaactccccaccggcacacgctgcaatcacaacggtttccgaatagatatggggctgggctacggcgcacagcagacgcagagccaccagctccagcaccgctttttctcccgcaggaagggcagaaaggtctgcatccttgagatttctggtagggattactgcgtggtggtcggttactttcttatcgttgatgaccgtctgcggatcacaggtaatggcgatttccttacgaaacggcatagcattggcaaccagattcaccagcaccggcaggctgtctgccatatcaccggtcagatagcggctgtcggtacggggataggtgcagagcttcttttcatacaggctttgcagatagtccagggtctgctgggctgtaaatccaagcaggcggttggcatctctttgcagagtagtcaggtcatagagggcaggcggcttttcggacttttccttgtgctccacctttttgatcgtgacatttgcaccctggcagacttctttcagctgctcggcagcggccttatccgtcatgcgctccccggatacggtaagaccgggcagctccagcgccacggtataaaagggaaccggcttaaaggtgtcgatctcagcttctcgctggacaatgagtgccagcgttggggacataacacgcccgatgttgagtgtgcggtgatacagcacggaaaaaagccttgtggcattgatccccaccagccagtcggccttggcacggcagagggcagcatcccgaagtccgtcataatctgcaccagggcgcaggtttgcaaagccttcccttatggcggagtcctccatcgaagaaatccagagccttttcatcggcttttgacagcctgccagctcatagacgctgcggaagatcagctcgccctcgcgtccggcatcacaggcatttaccacctccgtcacatccggggcgttcatcagctttttgagaatatcaaactgtttctttttatctttgcccaccaccatctgccaatgctccggcaggataggcaggtcatcatatcgccacttggcgtacttggggtcatagctgtctgcatccgcaagaccggccagatggcccacacaccagctgacacgccagccgttaccctccagatacccgtccttacgggcagttgcaccgattaccgcagccagactttgtgcaaccgatggtttttcagcgattaccagtttatatctcatcatcttcagcctcccattcttcccgcacaggcgtgtgcagttttttctctatgctgttttcctcatccagtagcaggttataaccaaaccggtagtcatagcggtacagtttccccagcaggtcattgatgatgatacggcaagccaaaatgacacgggttttatccacctgcatcagctggtagcgttgataattgctgtaatattcttcgtgacggcgggtattgcaggcggcatcttcaagtaaactatctactgcatcctgacaaccatcttctttttccccttccatgcagttcagaagttccatcatcaaaggaaagctctgttcatccataggagcttctgctgcaagaaaaccaatcaaagcggataagagcagccgagccgccgtctgttcttgttccgtcagcacggccattgttttctccgcatttggcaggatcttttcttccacaaaatctgccgcatcgtcggaacaaagctgacggatagaatctatggacaatgaaactgtcacggtatctaaggagaaatcaaaggggtcatcttgctttggctttctccgaagtttgtttaacatggtagaaagaatgtcgccgccaaaatacacggcgatcaccagcaggtcaaaaacagcaatcagcttgataaatataatcagaacactcatttttttcgtttcctttctttgagccagcgttccatctcacgatggcagatacctacgcagggacttccataattcccgcagccatagcaggggtggctgtggggtaaagaaggaggacgggaagtttccttcccgccctccggcctgcgtgtcatcatgcgttcatagggactgtctgtgaaacgggtcatttcacactgtcctcatcatcttcttctgtgctgcccccatcagcgtccggttcgtccgactcctcatcctcggtttcccattcctcggaatcttcctcgccataatcataatcgtccagactgtcattgcccttggtcttaggcttgttcttaacaagcttcaaataggcaaatacgccacagccgcccagcagagccagcaaaaggactatcgcagccgggttcagtccggcaggcttctctttttccggctccggtgtttctgccggaggttccggtgctttgcccgtacatttactcttatcagttacacagaccgggcaggccgtattgactgcccctgcttcacattttgccgtgcagctgcataccgcaggcggctcctcttttgcttttccatcttccatcagtgccatcaaatccgcttcatccacctgattcagaaagtgaacagcagtctttttatcctcattcgccctgtcaatcaggatgtaaaagtaatttccagctttggtcgtaacagtaataagctgcttattgcctccaaaatcatccaccagtgccgcattcccctccggtgtaagtgccggtgctggttctgtttcttccacagtaacattgctgtcattggtagaatcctctgccggtgccgccggagcctgttctgacccctgtgcaaaagcagggatcgtaaagccaaatgccacaaccattgtcaggcaaagggcggaaagtgttcggagcaatcgtttattcctcatagctgttttcctcctgttcgttattgtcatcagccaaactgccgggaactgtgccaccggacagcatggcgctcaactgggtcggggtcatacgcagggcgcgcaccatctggacgatctccagattttctgcctcggttttctgtgcttccagcgccttgagcttttcctgatactctgcgatcttctcgcggacctttgtaatctcctggtcaatgcgctcaattttgttctttgccatcgtctatcactccttcttaaaaatctctgttaccagttcatcaggccgtagcccttaatgctttgataattcaggtcataacttttaatcttgcaggcatcgccggaatttccctccacggtataaacacggctgccatccgtaccgatcacgatacctacatggtctgctgtcccatccaaatcccagtcaaagaaaattgcatctccgggagccagattgttatagcctcttgcaccccattgtccatgagactggaaccacggaacgccctgccactcacagcctgcaaagcgcggttcactttttcctgcctggttatagcaccaggatacgaagcaggcacaccattccacacgggagtcaaagccgtaccagctccagtagggataaccgcccacattgcccacctgacgcttggccagttccaccagctgaggattgccggggcgggtaccgttaatgaactgcacaccggacagatcttccgagccgctggtatcaggggagccgccgccaaacaacagcggcttattgcccatggtctgccggtaaacctgatacattttcatctgctccggggtcagaagctccgacaccacagcggaaatgggcttgctggcgagtttcacattcaaaatgtaatactcatagggaacttcttctgaggtggtctcaccggtctccgggtcggtggaggtctccgtgcggtagcgaatctccacttcctcagtaagcgtcagctgatactgtgctgcaaacacacgcgccagctctgcctgagcgctctgccgggtgtagccttgcaagacggcagagagaaatgctgccagctcatgagggtcatggccgatcataccaaggtcatagcgatactcgtcataccctgggtgactgctttctatgttgtcgatttcctcctgcaactgggcttctctggctgcataatctgcctccactgccagcatttccgggtcatccgacggataagtggtaccggagagaacggaaccgatgctctgcgccatcatggagcaggaggacatggtattcatcagcatacaggtaatgaggaacaaaacccctgccatcaggaaacccttcttgtggcgcatgacgaatgcccctgcctgctgtgccttttcttttaccgtccttgcggcttttcctgttttggatgcagcctgggcagtatttccagcagtctgaccggcatgtttggcggcggcatactgctttttgatggcctgcttttgctgccagcgggaaagtggattgctggcaaactggggattttcctgcaaagatttctggtacagaacatttacatttgccttttccagttggcgctctgcctgtgctgctttgcggtacggcttcagcttgtggctgcgatagccctcccgcaccagataagcgccggtctccaccgcttcctcggacttgtgggcgctttccacgcccacattgtcctgttctgtttcccggatctctttgtggagcttgcccgcaaccagatggacgggagcttccttgaccccttgagaaagtttggagggtggctttttcttgtcctcaaaggtcagcttcgaggtcttttttccggtatccgggtcgatgaccgtctgcctgacctttttctttgggatattggcctgcgccttatctgctctggccgcagctttctccgctttacggatcggcttttccagtgcaggatcagaccgttcctcatcagtaaagcgcaggcgcggctctttattcaaaccattctcccagcatgagggaggacatcatgtagtgcagctctgcataaacggccattcccacaggatcgttgaacatacagccggacaggtaggcataaaactgtgccaccacatcggacaggatcttcgcctctgttcctttcagaatcaggccgcccataccttctttagcacgaatgacgctccagacctctgccagacggagaagccccacctgaccggtctcattcagttcggctgcctgatctgccgccgtgcggcactcacttaccgcatcggccatgaccgtaagcagctggctgcgctgggcatttaccgccctgtcaaaaaacatcagcgggtttttattcaaaatgttggggttcataatcattcatcctcctttttcaattcttgaggtttggtggtcataatgcggtaaagttcggtgttcttcgggaagtggtctacaaacggcaggatcgtggagccatagaacagcaggccctcaccctcaccggagtgggtcacatagctaagctggtgcgtggaaatgcccagctgcttggcgagaatctggcggtctccacctgcctggttgagcatatacacgaagtcggagttttcaaagatgttctctacctcgcggctgctcaaaaggtctttgacattctgggtaatacctgtcggaataccgccccatttacggaatcgcttccagatttccaccgtataggcagcggtctgttcctccttcaaaagcaagtgcatctcgtcgatgtagtaacgggtagacttgtgggcagcgcggttaatggtaacgcggttccacacctgatcctgtaccaccagcataccgatttttttaagctgcttgcccagttccttgatgtcatagcagacaatgcggttgttgatgtccacattgctctggtggttgaacacattgagggagccggttacatagatttcaagagccgtagcgatatactgggcttccttttcctcctgttcccgaagcaggttatacagatcctccagtatgggcatattctccgggcgcgggtcattgagataggtctgatagaccagacgcacacagcggtcaatgatggttttctgcaccggctgtaagccctccttaccgcccacgatcagctcacacaagctgaggataaaatcagatttgagggacagtgggctttcatcatccgagtagtccaggttcaggtccatcggattgatgtagttggcagaggtaggcgaaatcttgatgacctgcccatgcagacgctcaacaagaggtgcgtactccgcttccgggtcacagataatgacatcatcactggtaagcaaaaagcagttggcgatttctcgttttgcgctgaaggacttaccggaacccggcgtacccaaaatcaagccgttggggtttttcagcagctttcgatccaccatgatgaggttgttggacagggcgttgatgccgtagtacagagcctctttgccgttctggaataattcctgtgtggtgaacggtacaaagatagccgtagaactggtggtcagtcctcgctggatctcaatctgattgagtcccaggggcagacagctcatcagcccttcttcttgctggaagtccaacctggtcagctgacagttatacttctgggcaatggagcctgcctggaaaatgttgttgccaagctgacggggattgtccgctgtgttcagcaccagaaaggtcaaaaggaacattctctcgttgcggctctgcaaatcctgcaagagttttttcgcttcactgccgtaagtagcaaggtcagatggaatgatgtccatgtcgtatccggcacgaactgcttttttctgttcctcgatcttactgcggtcaaggtcggtaatcttgcgctttaccgttttgatggctttcacctgatccaccgactgaatgtgcatactcacaatgagcgagctttccatatccagaaaatcagccaacagacggtcattcagctccggtgcgagaatctgcaaaaaagaaacagccccgtatttcttgcccatacggaactgcttgccggtgcggaacccaaaggagcttggtgcaataaaatcctttgtggacagaccggaaggagccagccagtcccattcaaactgaaacgggagctgttcatccatgtggaataccgcatgaagctgagaaagcctttctttaccgtccagcgttctggcagctacaccaagacgcttgaagttgttgagtatatcggtctcaatacgctccagacggggcttggcggctttgatgctgtctgcgtcgataccaaaggtcagatatttggtcttgatgagaccgttgttacctctggccagctgattttgcagcattgtggtgtattcctcgcggatactgtcaaaggcgtccctctggggcgggatggaaatggagttagcaaaggtctcctccgatgccgcaaggttcaaaaaagacagctggaaatgaatcgagctgtcaaaataattgaggaaatcacaccacccctcaaagattgccgtcttatcttcgttttgggagagctgatagttgatgtcctgaaactggatggtctttgtgtagtggctgtccgatacgcggcagattccgtccggccacatccgttcataagggatactgtcctgcgcagattttccttttttgtccgtgcggttggcgcggacaatggccgcttcgatctgcttcttatcggcgcgggacagctttttctttgtctttaccggctgcacagttttttcctcggtttttccgaacatccgatgcagccatttttttattgcggtgaacaatgtcatacacctccttatcgagcatttcctgccgctttaatacggcataaaagttattggtctggtagggacgctgcttgggacggatcacagctactttgagaatgttgcccacgatcttttccaggggctgtccatgcttttcgtacatagccagcataaagaagggcagcataaccagcatcatacacatagccgctacactgtttccggtaggttttctgagcaaaaagaaaagcggtacgccaataagcgctccgcccgtaaagcagataagctgccgcttggtcagattgaacatgacctttgttttgacttttgttaagtccttgggtacgggtacataagccaatgtggaaacctccttccgttttagtgcgcctgaaagactgatttggcgagactgccggttttgaacagcgtaaaacatagcagtacggtgtagcccacgcagctccagattgccatgatgatgtcatcttccagagcgatgttctgcaccagcacagcataaattgccacgcagacgataatgagaaacgcttgaaagcccagtgccagcagggatcggaggtaattctgtcccataccgccccattctttgcccatcatggcagccattggaacgggagccaccgaagtcacaaggtagatctcgatcatacggccataaataacgataaagatacagatatataacgcccacatggtaatgccaataaagagggattggaaccacaggccgaacagcggtcccaaatccatttccatcagtctcggttccagatcggtcataactgaggaaatgtcaatggacgcatccgaattgataatccctgccgcctgcgccaccacgctctgcgccatatcaaagacgcccatcacgatattccatgtgtttgtgacaatgaggatagcggcagctgatttgaacacccacttgaaaatcatccaggtatccacatcatgcaggttgttcttgtctgcaatcatctggatcaggtctacggtcatcacgatagccaggatcacacctgcaatcggcaccatgatggagtttgacagattctcaatcatattgaaaatactgctattccatccctgtggggtctgtcctacctgtacggatatatccgcgacctgttggtttacactgtcaaacatccccgaaaggttgctcataataccgcccaccagcatttctttcagccaattcgtcagggcttcaagtaagaaatccatacggtgtcaacctcctttccgccgcccccgcagagctgcgggagcggcaaggatttcatgcaggaacgcttagacagagaacagcccagagagcagaggtacaagaaccataccaacaacggctacaccagcaccggccataagctgcttcatgccctgagatttggcgccagatagccataggtaagtctttgatatgatctccaacttttccccggctccacaccgtgcgtgcagctttcaccgcacacggcgttccatcgaattcagttgcacagggcttgcaatacaacttacacacttcgtagcttgaacaagaaaagatttttaatcaatcaaaggcatttctgccatctcacgaaacttattcagctttaaaatttgcgtactatcgagattgagaaggttcaggtaaaactttatggtagccatgtcagaagcatggataagtttgtggacgggagccgatataagaacgaggtttccgtattcatctgtgccgcccttcgcagcaggcctcttgtggtggcagtggatatcatgggcttccatgattgaacccgtcactgcacattttccatgctgcgctgcatacagagaaattcgattatctgcgtattctatcgacctgccctgcacaggatttcgcatcagccaaagcatcgtcttagtgtcgatgttcagattcttgtgaatcagttcccgaccttctggcgtatacttgttgaccgacttccttttgtgctgggcatttctgctctgaacatatccaataggaactactggccgtccatgcagaaatcgcagttgactgctttttccatacttttctttgatatagccttttttcagttcgcctttgcgtgtcaggtcattccgcagacgattgtgcatctgctttttgaccccataagccagctttccaaagtcctcagaagcagccgttgcaatgcagtaatactggtgtattcctgccaccacagcattgtaggtcatcagctgcatgaactgagccttatcatctgccgagtgttccagctttttcacttcttctgtgagcttcttttgaactttcttgtacgctttatcgcacatatgcgattttacaacgtacttgttgctgcgcttttgcactttcagtttaaaaccaaggaattctgaatactgccgtttcagattgacaattctcgacttttccgggctgatatccagtcccaatcggtcttttaaccatttggctgttgcatgatatgcctttactgcatccgtatgggatgagcaaaaaatcttgaaatcgtccgcataccgaaccgagtgcatttctttcagattactgcgccgcaatgcccggtagacatggctttttatttctgcacctgcacgattctgccgtatcgtgaattccgttctggtcggcatattctcccactgggatgcaatccaccagtccagttcgttcaacacgatattagccagcagtggagaaagaattccgccctgcggcgtacccttggttgggtaaatcttttcaccatttggcaggataacaggggcttttagcatctgttttataatgcacagcagtttcttatcccgaataccaagtgaccatatttgccgtatcagctttgtgtgattgatattgtcgaagaagcctttaatgtcaaggtctactacatggtacaggtgttgtacctgaatcaacctgcaacactgtgcaatggcagtttcggcggagcgatttgggcgaaatccgttagaattttcactgaacttcgcttcgcagattggctccatgacttgcaatatacattgctgcacgatacggtctgagattgccggaatccccagtggtctggttttcccattatcctttggtatttcctcacgccttactgggcgaggatggtaattactgaatttcttctttacaaggcggacatactcatcctcgtttaattttgcgagatttcgtattgtcttcttatctacacccggcgttttacttccatggttccttttgatagttcggtatgccagtttaatgttttcttcactctcaatgattgccatgaggtgattgaatgttttgccattcctgctttccgcatacaacgtatcaaagatggattccatgccgtagtattccgagtttcggatttttccttgcttcttttctcgccgctccgaagtcaacacaggcatcctctcctttcgggttggattttcttagtcttactcgaagctgtgtttgttgtatcttgatgttactttcactgaattcgacttgtggccttccctccaccgcttactttttcacggtttcacaggtactacgccactactttcactgaaacaaagaatggttattgccctctcacgaaggtattcccatccaccatctcacagccttgcaacaggctaaatgttttcagcttcctgcgttccgatatttctatcatgggccacctttaggttcttcctctaagcctgtattcaattctttccgaatcgtgccgcctgtaacggcacatggactttcataacaaccattcttactcatccacgaatacctccatataaggagtaccaccatttcgatggtatcaacgtttagacttgtacattcagaagttcgtcagtatttccatacatactaaccatgggcggctgacacccggcatatccgatgcaccgtccacctctggacagctttcggctctgaccttgcggccagaactacgacatctttctgccgacttcaccgagcttctgacaatcggcggttgcgcgcctatgccagtcggagtatcagtgcggacgcttcggggcgttactccctcatttcatccatcgaaatatcagttctccaagattctggacttctttagtccttcaacttgtgcctgaccttttcagtcaggaacgcatcgcacggttgtcgttgccgtaaccttccaacaggttgatgacaccccagataccaagaccagcacccagagcgataacgagagtctgaagaacggtaattgcctgttcaaaaaatgccatatagtttgttagccggaatctgattaaaaaataggtttgtcatgtttcataggcatacaaaagccggaacaatctgccgcccggtttccgggggcatgattccggctgtcctcctttttcattatttttcttgcgattgtccgctttgtacgccaatggcctcaactgaggcagttgcggcaaatagatacgatcactcctttctcagcggaaccgtattacacgccctccgtgtctacttcatatacatcgcagacctcatcaggcttgagttttagtctggcagacaaaaatgcttcaatatcaaaggtatttcgcttgtctgcatcagctgtgtatttgaaattagggtgtctggtaatgtcatacttgtctgaaagaaacggacgcacaccgcgcaactgcaagatgcacttgccgccatccataactgccagctcgtcctggctcatcagctcttttcctaatttctgatagttgagcgagtgggaggtctcccgtccccggctctctccggtgttgtaagtgtctatggtctcctttcccagaacagccgccagctctttcagcgttgttggctctttgccacccaggaagatggaagtatccatattgccgatgatggtatcggcattatctttgtaaattgccttgagctggctctgtgcctgcaacaccagacaggcagagatttcacggcttcggatggtggccaccagcttttccagcttcggaatctgcccgatgttggcgcactcgtcaatcaaacagcgcacatgaaccgggagcctgccgccatacacatcatcggctttttcgcagagcagattgaaaagctgggtataacacatggagattaggaagttaaagctgtcatctgtatcactcataatgaggaacagggcagttttccggtctcccagcgtatccagctccagctcgtcataagctgtgacctcgcgcaactctgcaatgtcaaatacggcaaggcgcgcaccacaggaaataagaatcgacttggctgtttttccagtaacaaaatgtcaatagttttttaatcacttttttcaaaaaagcaaaaaaatagaacgtatagtttatttccatacgctctatctcacatttcatattaaatttttaaattccacaactgtagtttagctatcaaataaattatattttcgttgaacatacctttcaataaaaaacgcttgcatcgagtcttcatctgctttcttatgatgaacaacaagtatcatattactcatttcatattcttctttattacttttcatgaataggcgtccaaatctacgttcattttctttctcatcgtgtaatgaaatatctggattattataattagtttttccgccaataagaccatatgttttatttgtctttttttcaataaagaatttaatataagtaaaaaatttagtttccctgtctttatcttgatcttgacgaatttgactccattttttataaattgacatattgtattgtttgacttggtctccaaaaatttttatgagatcttcttgtatagaatcgaatgtataaaattcaaactgaagggttagtccagcagcttcaacatcaaaaactttactttccatcatttcctcctgattatttactgttagataaatgcccgatttgttactcacatggtatcatattttttcttcaattacatccacctaattttaatacactgccattcggcttgcttctgtaaccagcatccggttaattttctcctgcattgtttcctttgcatcttcattgaaatgataacggacaacatagactgtctgcccgattttctttgtaaatgtgttcccctctgtttttgtattcatcattttttccataatcattttttcctttccttttgaatcaccggcagagagtcattccattggtctctgtcaggacattattctttcaatcaggccccaaatgggcacttccagtttcgcaggctacctatatatagccttttcatttttgcttgcaaaaagccttgtgatcacagcacttttttaacgtaaaaagcgttttaatatgatgcagtcaacgacaagaagcatacctaacaaatgtcattgtctatcacttctgttttctctgccgatattgctctggttaatgcctaatattcttccctgccaggcaagacgataagtacggcgtatgcttttatcgtgttgttatactgagaagcccgacaaggagtaggcacttaaaggttattttcaggcactttataggcattaaataggcacttagaaatacctgtttttccagtgtttatcatgctttaggcacttaggcactttatttttaaattaataagaaaaaaacatatacttataaaacccatatatttaagcaggatatatttcaggcttttctagtgcctaatgccttttccagccggatcaataattgacgtctttcgtcctcaccttgacatggacaccacgaaatccccggcaaaaacgaccgtttcctactgagatattcttatcataagtcattccataatcagctgaccgctccttaaatctccttgcaaaggatctttcgcttacgggtacatccaagttatcattgcaccatctgcaataagcaacatataaatctttagatgtggcatgagtgcctttttccagtccgatgtatccggttgattccagaaacgataggatattatcatcatcctcccgcatttcattcatcaataactgggatttattactgatcgtaaactgataatcgttacggatcagtctctccaatccctcaatgcaccatagaactatgccttccacttcttccatcatcttgtctgccaaatagggatcattgattctatccggcggtacatcttttgtttccagaataatctgacgtctgtaaaaaccttgactcctgtcaaaaagcgactttaatgtgccgtttccaaatgccagtattctgcaaacaagaagtccctgatagctttgtttgttttttttctctaaatccatttcgtcctcagctgtgacaattgctttaatcacattcgttgatggtaatgcttctgttttcatatcatcatccagatacaacagcttgccttcctgatcggctctggcaaatttgtcagtttccagtttctgaaggcttcccgaattcatgttatgaccaaatattctttttaagattctgccaatacggctttttccttcaccgccttttccgataatcaacagcatcttctgacctctattgctgggaatgagacaatatcccataaactcctgcaggcagacaatatcatccgcttcgagcagtccgtccaggaatgccagccatttttcaggtttaggtgcatccttgttataattgaccgtcaatcggttttgcgtccattctttctggttgataaacttctgatttacaaaataggttccattcttaaaatgaaccctatcctcttttatggaaagcggatctgaacgggtatacatcttaaatccacttaaaatagccgttactttagctgaaattccgcttgtccaatagtgctcaataatgttcagaatctttttctccatctcatcgtttgggattgaacgatctatatcatacaatattccattgatacacttgatttcatgttgctgcagaattgtctgatacagaaggatttcattgatctgcttgccatcgaaccaaatcggcagttccattttcggcaaattcttttccacctgtgtctcttcggttacttcttcaactttctgtaacgcttccagacgtgcaaccacatcgcccggaagattcttccttaattcgttgctcaatgttctttacctcctcctgacagtccagaatcaatcttgcacgatcttccagcgaaccactgagaagcacatccatcttgtattcaataagcgtatatttttccatcgcttcaacaaataacggatgccaatcatcatcttcaattctgggagcatactcaactttccatttctttaaaagatggaagtagtcactgtatactcgaaaaaaacgaatctgttgctcgtgaaagaattgatccagtgtctgtttcttttgttttggtttttgataatctttcgtcttgttataactctggtatttttcataaggtacagaaaaatcctctgccagtttttcagctgactcttttacagaaagattgaaatatttagcgacaaaatcaatcacatctccatctgcctgacaggcaaaacaatgatatcttttatcaagcttcatgcttggattcttgtccggatggaacgggcagacagccattccgtttcgtccaactttgattccataatattctgcagcacttcttgcagtaacagcttccttaacagcttcaaataatttcatacctgctcctttccgagaaaacaaaaagcactcgcattgattcaataacgaatacaatggaatgctcttatctgtcatctctattccatgattttttcaaatcattctttttatttgcttctctttctgccagctcttttttcttttctgctagacggctcatgatcgacggtctggctttttctttgatttcatttacaaccttaacttttgtttttggctgcagtaacgaatcttttactgtttgaactgccgtcatagctttcatgattttttttattacgccatccaaacgattttttgcataattcttttctttctccgaagctttgcgttgtggctggtcgatccaattctttgtgccttcaataagttgaatatcatcttgccgggttttaatcatcacttcgtttgtaacttcttccacagctttctcataagcaacatctgaaacatcctgcaataaagattcaatatcatcaatctcaagagtaagcttctctaactggtttttctgttcttctattagatctccctgtttgaaaatacggtctgaattatttgcaaattctgtatcctgctgttttattttttcttcctgtgactgaataatttcttcatttgcacgcacataccttgactgttttgcaagctccagacgattttcgtttaccttatcaatctgcataagaattgtttcctgttgatccgcaatttcttctttctgcttcatacggatataatcttgtttttccaaatactttcttccaccatacgatggttcttcatcaagttccagtccgtgacgtttacagatatctaaaaacattgtccggcaggcagaatcaaaagcaaccttgcggttatttgtctttgatctcttcttttctggatctggaagttcaaagccaagttcttccagtgctgtttcctgtttcggctcaatttctccatatcggtttgtagcatcaaaaacatgacgctcatgaatatgaggtgttgcttcgtccatgtgcagcgaccaatcaatgatatgtacgttagagccaaaacgctcatcgaactctttcttaaattcgtcaaatactaaaatcagggtttccacagaagcatgttcatctattgttccaagctgatagatactttcttccggacaggtctttttgtttttccaaacatcttccacttctttgcatctgtctgggtgtctggctttcacatgtctctcattttgcttcataacataatttccataatgctcttcatagaatgccagctcaatttgttcaaaagaaaaattattctcttttcccttatcttccattgtggtatatccctgatagcagtcccagtaaatattttgccggactctttcattgtcgatatgctcactgtgttccggattaaatctgcgatcattatgaagcggattgtaaactccattttttccagatctgccgttatgccttgttcctttcatttcacttttctcctttctttcaagttgtttccccgaagggattgcagcgaagctgcttaaaggctctgtcaccgttacagatagtacccagtactatatggcgaaacgccatatcactgggcaatggctgccgcccttaacctgctaagggctttgccccttaaccccagcaaggtgttgccaccctttgcattccaggcacaaaggacttccagccctctgtactcccggcagacaaaacgaaactcctgccactgtcccttcggcatgttttccgttctgcctgtttttcaaaaatcctctatttcggattttgtgaaaataaaaaagccgacgcaatttcaacttatacaaaagtccaaatacatcggctcaatcctttgacctgatcggtcattattcattttttccgactgactcatacagtctatttttaataatgagcaaaacaaaaggcattaacttttttacggttaatgccctttgggttgatcattattgaaataaactttttttcacagtttcacttacaacatctatcaaaagttgtctcatcgaattttttaatatatcccctgcacactttatgcccttcttatattttgcaatagctattggtgtcgccggagtttcggtgataagatctggaatagcagtttttattaactctttcatcgactcatccaattcatcttctaacgaaactaacattactgcattatctaaaataatttttgtccaaggatatggtgctccgcaattatagcaatagtccggtctgttgtaactccctgacaaatcaacaatcccatctacttcgtattttccatgaatcggagaattacactcaggacatttcgaatatgtttcttttccacatttggaacaaaatttttgataatttgcttgatatttactaacaacatgaccatttaaacaaatcgtagcattattatagtgtcccatttttattcctccacttcaacaaaatcttcttccattttcaaatcaaaaatagtttcttctataacttgtacacactcatcagtattcttcaaaatgtcttttccccaaaatcttataacagtccaaccttcaaacaataactgtttttcaatttctatatcccgttctttgtttcttgatattttctttatccaatagtcactgttttttgctttttgcaatctcggtttgagtacttcccaatcttttccatgaaaaaattcgctgtcacagaatattacaattttatacttagttaaaacgatatctggctttcccggtagcttttgataattttttctatatctgtagcctttactccataatgcttttctcaacgcaagttctatttttgtatccttgctttttatgttctgcatatttttctttctttgttcagctgtcagattatctgccattctatcaaccttctgtatttttacttaattgcttctaaaatactttcagcaattcgatttatgactggcacgcaaactgaattacctgcctgcttgtatagacgagcgtcactttgttttttcggaagtttataatcttttggaaatccctgcgtattaaagcattctctcggtgtcatttttcgtaatccatatttggttttcacaatacatacattatgaccaccttccccttgattagcagtgagcgtagggactactccacttttattctgtcgtacatattttcttctccactgataaatagctgggtgatttatgtcttcatcctttgtcgcttcaaccaacaatttataaatatcccctttatattttccttctgtataataatatttgtcatctacttttccgtcaaagtcaataatatctttaacagttgttgttaatggaattgacagcggccaatgaaatttattaagatcttcttcatctttaaaggcaacaatataaatacgttccctgttctgagccatatttccataattcatcgcattcaacacttgataggtataatgatatcccaataaatccagctgttcacatattaccctaaacgtgtttccattatcatgtccaactaagtttttaacattttcaaataatgcaactcttggtttgtttgcttcgaccatacgcataagctcaaagaaaagttctcctcttcccttcttatcctcaaatccttgtctatatcctgcaatggaaaatgcctgacaaggaaaaccaccaataataacatctgttttgggaacgtcttcaacaggaactaagtgaatatctctttgatcgactttaacagtcggataattcatttcaaatgtttcactggcatatgaatcaaactcatttgcatatacggtcttaaattctcctgtttcttcaaatcctaaatctattccacctacacctgcaaaaaatgaagctacactaaacattatctttctccttgctctttcgtaatgtgtacatattatcatatattgcggcgcgccgcaatattctattttgaaaaggcagagataaaacactctgcctttcatattatttaccgattaatctttggtagtattctgatagtctgtcataagccttacatcttcgaatatcaaaaataatgtctggctctaaattgtttgcatccacaaataatgttttaagacttacatgtggtcgtcttccctgatttttttgttcttgtattgtctgagttttatttgctggatattttccaaattcttccgaatttatattcaagtcataaatgtatagcaaattatcatctagcttaaatctcagaaacaccaaatcatcaaatacacattttggtccaaatgaagacaaatctccttcaaatcgggaagttgctttaaattcaatttttcttcctgtatttggatcagtagcgtcgcctacttcatcaccgcgattccacaaatatcccatacaataacaacccattggttcgcttattgcatcaggcatgtttatacctctatgactgttattagaaatatatgtgttcaaatctttccatttaaaataggcattgcaagtttcatcaattctggcatcatctattgtgatatagccaaattcattatatattgccatattacctgtgttagagtgttctatctctgcacataagaattatagcatatataaatcattttttccttaattacttgattacgataatgactgccactgtctttactcccgctattgaatcattccgttcacacttatcacaccgtcaatgcatccagcatgacttgaattacttctttcaacatcaatccatctcttaatcccatacggtaatagaattcattcagatcactgcatttatttgatgtttcagtcatgtaatcaaataaaattgttctctgtttgtctgaaagtttctgaaatatcttttgcaatttcatttccaatttttcattaaatggatcatattgctgtccgtctttttcttgatagacctgctccattctttctccgataagatcattcataaattcttccatttttcctgttaattccatctttttaatctcccatcaatatgattttgattgtttccagccacacaacaaaccaacttgcaatgataggtagcacatacagtaagaaccccaccgcaagcatcctaatcatctctgtgcctgtttcctgcccgaatccatatcccaatatagctgtgatacagataatcccagacaggatatgaaatacagttgcggacagccatgtaatgaacatgaccaccagctgtacgattgtcaggcttatacgcactggcaataacagaatccttataatgagttttacaactaccatgactgtccacccctttcactgtttcagataactacgatagctgtctatcacagaatctgtcacaccgcttttgtaaatctttcggatatcaacgattttttcatctttcaaaagtttcagccagtccagtaaatcttttctgctgtttgcaaaattacaacatcttccgtctgcatattcaatccagtatctcataagtccctcctacacatacaccagttcatttaaaataatttcatctacccggcttcttgcattgtttgcccggcgaacccattccatctgatctctgcttttcaattcttccgtaatgccttcctgctccataatctgttccatgaggaaatccctgcgttccaaacactgctcattcagatctgcgagatacgtccagagcttaccactcaatgtcagataggaatacaagccactcttgtaatctttcagatagtttctgtgaagacttccataaaaaccaatctctcttttctcttcgggtactgcgatcagtggcagatagatttccccgacaaggatataatccagaccattactgttatcgtgaatgattctttctaatttgctcatgctgatgcaactcctttcttcggttctgctgggggaagcagtgatagcggaatgaacacaccttttgcaatatcttcctgccggatctcttctttttttgcatccagttcggctttcttttttgcctttgtccgttcatagtattcctgctgctttccatttgcttttcttctcagataattctggtgaagcctgtcttttctggcttcccgtttttccatttcttcaatttcttccggtgtcattttcacctcaccgaaatgtggcggtaaatatctgccgatgaagttaaaatagatttccacttcctgtgtcgtctcaacgcttcctttccggtcacgctcatgcaccacaatcttttctacaaattcattcagcatgtaagtggtcaattcctcaaaattttggtatttatcaaccagagcaataaacttctccgctgatctgcgaccttcttcatagcctgataattcagcttccatatctgcaatttctgccgacaaatctttctgttctttagaatactgtccatcaagaatcgcatagcgttcatctggcagcttgccaagaatattgtcctcataaattctgcagatcagtttttccagttcctgcacacgcttttttgcctctgccaatctgcttttcaatcttgtgatctcactggactgctgtgaagtctgtgccttttttactgtctccaaaaattcttcacgattcaactgtgaatactccgcaacagcctttaaaagttccttaatcagctccataaccacatcagcattaattctgtgctgtgtctggcagagtgttccaaccggaactttagaatatgcagaacaagtatattgtggtacttgcttgccattatttactcgatggacatacattttggaaccacagtctgcacaatacatcagacctgtcaaggggtgggcttctccccatccatctgggtaccttctcacattgcttcggattctctgcacattgtcaaaagtttcctgatctatgattgcttcctgcgtgttctcaaacaccgtccagttatcctcagatacataatggcttttcttatccttgaaatgttttctggtcttgaagttcactgtatgaccaagatactctcttttcttcagaatacctgcaacagtagaagagccccagccataaggatctttgatttcttctactctgcctttccataatccggcatctttctttgccatatgaaccgctggtatctcaaccttatcctctttcagtgccttggcaatctgatatggtccgtacccgtccattgtcatgtgaaagattctccgtacaactacagctgcttcttcatcaacaatccatacattcggatcatccttgtctttcagatatccatacggtgttgtacttgccacatgcttgccggattttcctttcgccttgaaagttgattttatctttttactggtatcccttgcataccattcattcatgatatttcggaatggagtaaaatcatcgtcctcccggaagctgtctacattctcgttgactgcaatcaggcggacattcttctgtcgcagcaattccatatattgtccgactttcagataatctcttcccattcggctcatatctttaatcagaatcgttccgactttccctgactccacttctttcatcatggcaaggaaacctggacgatcaaatcttgtgccggagataccatcatcagtaaaatgaacaagattggtaaatccatgttcttttgcatattgttccaacagtttcttctggttcgaaatactgttggattctccgtttaattcatcatcacgactaagacgttcatacaacgctgtcatgaatccttgtttctctgtcatagtcagatgttctccttccttcgtttattaaattcctgttctcatcccatatccgttcctgtaccgggtgctgatgtttccgggacgtattaaccagaaaagacacgctgaatgcctattcagttctggtatcactacgggcaggctgtttcgttttcaaggttcgtgtaagaagtaaaaaaaagattcttacactaaacgaaatgctcagagggctttttacagcccccttactgcatcttttttgatttcgtgtcatctttttaaagttccttacacaatctctgtactggcgaaacaaaatacggacatgttttgaaattgttttttacaaaatacaattttggtctttaaggtaaaaaaataagcctcaagagactttttaatcattttggagctccaactctttaaaattgattgattaagaagtctcttcaaacttactacacctgccgccagcttatatttcttatactggcgcaccgcaaagtggtttggcttttctgcttccaatgcgtcaaacatcagatccacggggtttttgaactcctcgtcatcctcccggacttccatggcgttgatgaactcaataagggtggaaaaattctgttcctccaccggagcctcatagtggatatagccaatgagcgcacaatagagaagcgtttctgccttgacccagaaatcgtctccggccttgccttcgcctttggtgttggcgatcagcgttgtgaccagcttcaagatgtccttttcgctatggatataggcgaaagggttatagtgcatggatttcttgaagttgatggtattgaggaccttgattcggtacggctcataaatgaccttgccgtgcttatccttcattggctttccgtctttccccagcttgggtgcgcccctttggagcatttttccgcactccaccaaaatggttcccttcgggtctgtgaccacataggaactgtgcatctgcatcagattcggtttgagccagaagcgggtcttaccggaaccggagccgccaatcaccagcacatttttgtttctggcggtctttgggtccttggggcggctgttcattgtcaggctctccgttttcgtcagaatcacattgttctgaaatacaggatcaacgtaaggtgcaatatcctcacgggttccccagcgggccgaaccatattccaaaccatgtcgatatttcttggtgttcttgcttttaagatacaccgccagcctcagaccaacaccgcagcacagccctaccaacaagtccaatggatgcaggcttggccagaaactttgcaacgtcccaggcagaaccgcaaccagcgaaagaaacttttctgaagcatccgccccttgtgccattcgccatgcctctccaaaattggtagcaaacagccccagcaggatatacggcatattcagcaaaatgagctttttgatgtccaatgtctttttcatcgttccagctcctttcgcttggtgcgatccaccacggcatttttgaccatctctttgaactgactgagttttgccagcacagacgggcgttccgttttctcggccttcttgacctttttgctggtgtactcggtaaatgcagcggtcagcgcatcggcgtcacggcctttgaaaaagatcaggtacttgggtggggagctactgcggtctttcttcaccgcatagtccacaccatatttccgggcgatcttctcaaactccttgatagatgggtctgtgatctcaatattggagatcccctgattctgaccaatgatctgcttgacggtctgtttgccgtggggtgtcacaggagcgtcacggcttctctgcttttgcagcttcttttccttgcagtgggccatgtacttgctgatggcggctttgagcagcctgccggtgaactttgttccactgacaaccagtgttaaagtcctgttttccacttcttcctgcattttcatcgcctcctttccacaaaatgtgcaggggtggtgcacttctttctaaggcgggaccaccagccgccggagaaaatatttcttcatcgctccatcccgcggttctttttctttaccggcttcttatccggcagattccactcttcccgaaactctgccacacctttggggtcaaatgccttcaacttctccagatcaaaggcaacggcagaatattttccataaccggactgcacctgatagggaagcaccttccccaacttgttctctttgatgaatcgcagcaaatccttgctgatgtcaccggaaataaacgcctctccggggtccagggaatatcctggtaggttcaccgtcatatctgcaaacgcctctgctccatcttctgtatgggtaatcatgccgatataaagccgctgattattcgcatacattccaagttgcagcgatatggtttcttccccatattcccacttaaagggtactttcttttcctcattcatatcggattcctcctatcgtatctgttctttgtggtcataaaacaaatctccatttctgacctttgcatggctgagaatcttgatctgcccatttgcctgactgtccagagctttttcatagcctatatctgacaaaaacaggcgggtgcgttctcctttccagccaaccggggagtcatgcgtcagtacatcaaaaataatcatgtgccgggtgttctccgcaaatcgctggagatccatgtagtcatgaccgtgatagttctgcgccccggctttctggcgcatttcctccatcagctgcccgattgttttgccttcctgcataaaacccacttcctttccgttcttatgagaccagcaagatcatctcccgcagctgagcaaagtagagctttccctttggcgtaaccagcgtgtaggagccggtatgcccgtgattgcagtagtctttcacacagaacagccccgtatttttcacattggcatagggcagcacattgccggatgctgtgcggtacacaaaccgtcgttctatcagaaaccgaacaaaccggcgctccgggacatccaactctttggcggttgtcctgagattggtgctgtgctttaagtcgatgaacaggtcatagaaagcggctttgccctccagctgtgcattttccttacgcagagaaatatttgcttcacgctcagccaacaagtctgaacagagcttcatcagagcctccggggaagtagctacctcccaaagcttctctcttgtgagataggccccgtgcttgcgaatggtaggcagaacctcatcgaatacccactgttcaaactgttctgccgatggcaatttgctgtgaacaatcaggcggtacaaatctccttcggggataaaagtcatactgattttgcggtcggggctttgtgggtgaggtgcgtcgcgtttcacgacatacctacaatggcggataattgcatcgcgggaattgctgtaccccagcgcagcggccacatccgttccgcagaacaggtatttgccgttttcttcgatgacccggatactgccaaactccgggtttttgaaaatttccatctggttcatgtcgtgcctcctttggcatgataaaaggcggcctttaccagccgcctgcgtgcatatcgtggttgaccaatgaagtgaagtgattattcatggtggtaggcgcattgaacagcaccgcaagcaggtactgcttcatgttgcgtacctgggtggtgttcttttgcagacagtccatgacaaactcgatgtgggagctgtccagtttcaaaaaacgggaacgcacgatctcgtgaggaaagtctgccccagagatccgggtggtctttcgtctggcacagaccgtttctaccaacagctctacgatctcattcaggtcatccaggtagagaggataacgctgcttcagacagtcatactcgatattctccaaaatcaattcccgataattttctatctctgtgacagacatcgcatctcttcctttccgttccggcggtcttgccgccgctgtttcccggaagggaatggaatcggtacttgatccataagtaattgatttttctgtatttgatttctctatatttaattctgcgggcttttccgtatccggtttatccatatacgggttttccgtatctggtgaatccgtatccggttttctaagctgtggctgctcgtatatgacatactctgtatcgctgatgcgtccctgccggtcacgcagcttgtgccgcacaatgtaaccggcagcctccaattcccgcaacgcagcgcctatggcatccacgccctccttacagatctttgcaagaccacgggtggtgtaattccagtcctctggcaaagacagcatcatggaaagcagccccttggcttttaacgacaggtttgcatttcgtaaatgatgattgctcatcacggtataatcacgggtccgttcaatacgaaaaacggccatcgacctcactccttccgaattttgggtacaaaaaaaccgcaatcctcatttcaaagaattgcggtgttcaacacttttcaaattttcttgcatagaaccaaaacagcggctttcgaggacgcgcctctgtaaatggctcctcctgggcgaaaggaagtgtttgcatcactcggtcaatatccgttgaatccatgtcatgctgagatttgcaatcttcccggattgcttcttgaatttcctttaccgtacacatagtcattcctttcctttcgttgtatgggtttatgagcggcggcgttttcccggtttgaaatcgaggatatgtccctcaatcacacgagcgcaacgcttgatcttaatctcccggcgctgctggctttgcagggcagcctgatacccgtcctcggtcaaaaacagccgcatttcctctccggggctgccgtaagctgtgctgggacgcaggacggaaaactcaatcatccagcgggtgttatcccaaaacctctctacggcgagaatgttgtgtcctttcagctcgcgggctgaaatatccctcataggcggctcctttcatcgttcctgatctctctgacgctttttctgccatgcctccagcagcttgatgatggtttcctgcatccgctggggcgtatagcttttagggaaatactttcgcaaggtgtcagaggtaaatgtcactcggtccagatcgcttttcttttcctcacccatgatgacacgcatcatatcgagggtcagatgcccctcctgactgtattttttgagccgctgagcttgagaaagagaaggggtagcctgttcgctgtccatcgcgtccaacaggtctacctgttcctcctttttgagaaaggacagctcataggcagggttcagggcaatcttcttttcatccaccatatccatcaattcaggaatcagctctgtcagacggatatagcgctgaacttgatttctgcttgaaccagcctgctgagccaatatttcatcggctctcaacttcgtcccaacttgggacgaagttaaatcaactcgctctccctgatgtttcatggcatccagcttcatcttgtaggcaaatgctctttcactggggagcagactttctcgttgcaggttgctgtcaaccataatgatcgtggcggcatcatcatccaaatcccgaacaatgaccggcatggtctccttttctgccagctcactggctctgtgccgcctgtgtccggctaccagctcataaccgccctccgggtccggtcgagcaatcgccggaaccagaacgccatactgcttgatactgtctgcggtctccatcatggcttcgtcatccttgactttgaatggatgccctttgaacgggtgcagttccgacagcgggatttctactactttttctctctgagcatcggcacggctctcctccgtagaaaacagatcatctaccgatgccagttctacttttttcgcgctgcttttcaagtttcaacacctccttcgtcagatttcgatacccctctgccaccttaccgccagggtcatggacgaaaatgctttttccctctgcgctaatttcctttgcacggacagagtgtggaatctccgttccaaagactttgattttacttccataggtgtcccgcagcaaagcagcaatctctttggcaaagttggtgcggttatccaccatcgtcagcagtataccgtcaatctggagctttggattgatctgccgttttaccttgctgaccgtagataaaagctgttccagtcctttggcgggcagatactctgcctgaacgggaattatgatcctgttcgcagccgccagcgcattgaccgtaagcatccccaacgagggctgacagtcaatcaggatatgggaatattgtcccttcagtgtgtccagatattgccgtaaaaccgtttcacggctcatggcgtttaccagagaaacctccataccggaaagctgaatatccgcaggcatcaggtcaacgccttctgcatgatgcagaataccttctccggggcgtataggctgatccatcagaattttgcccattgcatccgacagtgtaaatggcagcttgtccggttgcggatttcccaagctgattgtcagacttccttgtgggtccccgtcgatcagaagcactttctttccggcctgtgccagacctattcccaagttcgcacaagttgttgttttgccaacgccgcctttctggttggcgatggcgatgatttgcgtgttcaaataaacctcctccttctacaaaaaatatccctattccgaaaaatagggatgaaaaaagccgcttactcaaataaatgaataaacggctatgtaagaaatattcgattgtaagtaaagttttatatcactgcaaaataacgaagtgcatctttgattgcttctaccttttctggtgtcggatgtttcctcggctgtttcaattcttctaccgcattaggagcatcatacatcggcaatcccaaatttcgctttacctctgcgatatatgcggtatgtaccttgaagccgtatttcgcttctatgtactccttaatcattttgtaggtcactttttctttgggcttatacgcttcggctcttttagcaatactatctaccggaatcttgccctcgccctctccaaactccacatcaatgtggatataactgtcggcttttttgtgggataaaagaactaccgtctctatatgtacggtactcgggaaaagatccacacacccaatccgttctacctgatatcctcttccctgcagaagctccagatctcttgccaggctggtcggcttgcaggcaatataaaccattctttccacaccaaaatcaatgatcttttccagtgctttcggatgcacaccgtctcttggtggatccaatacgatcagatccggtacttcacccagatcatcgattactttcaacacatctccagcccagaaggtacagttatcgagtccatttaaagcagcattttcttttgcagcctctacagcctcttcaacgatctccacacctactactttttttgccactggtgcaaggatctgtgcaatcgttccggttccactgtagagatcaaagattaccttatctttcgtctcaccgatataagatcttgctgtttcataaagcacttccgcgccaagggaattagtctggaagaaagaaaatggtgtgatcttgaacttcagtcccagaagttcctcatagaaataatcctgtccatataaaattttggttccttcatcttttaccacatccgcaaggctgttgttggttgtatgaagaattccggcaagcctcccatcataagaaagaccggtaagcttttccaccagtctggcttcatctagctgtgcctccgatgttgttaccagatcaatcagaatttctccggtgcgaactgcctttctcacaagaagatgacggaaaaatccagtatggcgcattctgtgataatacggaagacctgtatctgtcgcaaactccagaacagcctttataattcgtctgaaatcctcatccacaatcttgcattctgcaacatttacaatatcgtgaaagctgcctcttttatgcatgccaagtgcaagaggtccgtccttatattcgtctccaaaagaaaattccattttattgcgatatgcctctctaaccgggctttctttaacaccctcccagatataatcaccatcaaccgccgcatccatcattgcatggatctgcgcttccttcatctccacctgcttttcatacggcagattctgataagtgcatccgccacagactccaaaatgcggacatgccggctgacattcttccggtgaatgctccagaatttccagaagccgtccctctgcctgaccttttcgtatcttattcaccgcgaaacgcaccttttgttccggaacggtattcttcacgatcacttttttttcttcgtcctctaccacggcaaatcctttattcgggaaatctaccctttctatatatccttctaatatctgtccttttttcatctatctatataccctcacatagaaaaggcaggaatctttgacaattcctgccttcgctgctttcttaatattactgtacttcatcttcatcactgaagaaatcattgtcgaaatcatcgtcaaaatcttcttcaaagtcttccagataatccggagtaaagaaacaatatactgcatatgcaattgctgcaactgctgctaccgcaccgataattgcaagaatccagagaacagttgtcttctgatcatcatctttcttatgcatcatatcgttgagtttcgttgttgcaagtaattcttcgattctgttcatctccatacacgccctttctgccgtcactctctgcttcggctcactcattgtttatagctagtataccacaaatccatgcataatttccaccatattgcacagattttccgaaaaagaatgtgtttcttaggcacatagtgcaattttagtcaattttctgcagttttgcaaacatggcaaacatcttcttcgtgcccgccgtatcaaagtccacagtcacttcatagtctcgtccgccttctgtgatctgtgtcaccagaccttccccaaacttaatatggcgcactctgtcccccacatcatatcccggaccttttcccttggtcacagtaaactgctgtgcaggctttgtcgctgcgaacgcttttgtcgcaaatgcctgctttgcctgacggtaagcagataccttgggttcctcctctgtctgctcttttttgaacagggcaccggtagaaagcagactcagcggaatctcttttaagaatctggacatcttattatactgtgtctcaccgtgtaccatccgtcgtcttgcacaggtcagcgtcagattctcctttgcacgggtaattcccacatagcagagtcttctctcttcttccagctccgccggatcatctgccgtgatcgtcatatagcttgggaaaatcccatcttccaggccggcgagatagacgtgtggaaattccaggcctttcgcactatgtaaagtcatcagcaccacatagtccgtctcctcatcaagactgtcgatatctgcaaccaatgccacttgctctaaaaaaccggaaagtgtcgatttttcatcttctgcttcacagaactcctcgtatgcaacaattttatttcggagctcttcaatattttccagacggctttctgcttcttcatcagaatctgcctgcagttcttctacatatccagttgcatcgataatctcatccatcaattccgctacactcatgcgttcgccttcggctttaaaatgctcaatcagggctgcaaaggattcgattttgccaagcgcacgtccgattcccggaaccgatcctgcagccaggattgcttcatagaaactgatctcccgttccgttgcataatcctgcacccttccgatagttgtcagtccgattcccctcttcggtacattgatgatcctccgtactgccagatcatcttttccattatctactgtttttaaatatgccagcagatcctttatttcgcgtcttgcatagaagtttactccaccaacgatcttatacggaacattggataccaccatcttttcctcgaatatacgtgactgcgcattggttctgtataaaatagcgaaatccttatattctctttttccactgttcaccttgtctttgatatcactgacaatataatccgcctcatcgtaggcagaatcaaactgacggaactgaatcttctcaccctcaccattctcggtccagagcgacttctcttttcgtcctgtattgtgacggatcacttcatttgcggcgttcaggattgtggatgtggaacggtaattctgttccagcttgatcactttcgcattcggatattctttttcaaaattcaggatattcatgatattcgcacccctgaatttgtagatcgactggtcgtcatcaccaactacacacagattctgatacttaccggcaagaaggcttaccagcttaaactgtaccgtattcgtatcctgatactcatccaccatgatataacggaatctttcctgataatactccagcacgtccggctgtgtctgaagaagctgtaccgtctttaaaagcagatcgtcaaaatcgagtgcattgttagctttcagctgcttttcatactcggtataaacctgtgcaatcttctttttcgcccaatccccttccgcacgaagtgtcatctcttccggtgtgacaagctcatcttttgcagaagaaatcgcactaagaagcgaccgttccttaaacattttcgtatcaatctgcaaatatttacacacatccttgatcagtgtcttctgatcatctgcatcataaatcgtaaaatttgtatcatacccaagccggtcaatatatctgcgcaggatccgcacacacattgaatggaaggtactcacccagatactctccgaaccgaatccaacaatctgatccactctctcacgcatctccccagctgccttgttcgtaaatgtgatcgccaggatattccatgggttcacacctatctgatcgatcagccaggcaatcctgtgtgtaaggacacgtgtcttaccggatcctgctccggcaaggatcagaagcgggccctctgtatagaaaacggcctcctgctgtctgtcatttaatgtatcataaatactcatatttttgttcctctttcttctcctctctcgaggctctattgcatcattatattataaaaaaagtggggtgtcaaagaatctctcgtccctatttttcgtcgtaaaaatagaaaaatccagctccttttttcttatctgtaaaattttgcaaaatatctggactttaaaattttaatgtgctaatatgtcattgtatgaatgagtggggcagtttatgtcacactcttattgattatttgtcatggagggataatataatgagtagaaaaatcagaacagaagcggtcgattctttatttgatgccgttctcagtctgaaaagcagagaagaatgctacacattctttgaagatgtctgcacgatcaatgagcttttatcgctttcacagcgttttgaagtagctaagatgctacgtgatcagaaaacatacctggagattgcagaaaagactggtgcttccacagcaacaatcagccgcgtaaaccgctctcttaattatggtaatgatggatacgatatggtatttgagagacttcaggcaggggctgaagaatccgaatcttaattttacagacaccggcaggagttggtagtaacagctattgccaaacacataatagcaaaaaggaacgaatttcaaaatctgaaatccgttccttttttattcttcttaaaaaagctaacgcttttattttttcttatccggctttggaagttcgtccaccattttttcaatcagttgctttttcacatacacatcaaaactgagattacagataaaggcaaacttctgaagctgttctctttcttcatcatccacacatacaaaagaattctcagcagtctcatacgccttacgaatactatcctgcaactctccgatcctgcttttttccatcttacagacttcttcatagatactttccatgtcaaattccgaatccacagcaaaatatttgtctgtcagtggctttaacaaaatctcaatatctttgattgagagcaggttcttaaaataatagacaaaaattaaaaccagaaggtgctctttggaatactttttcttgttcggaggcggaagcagattgtttttcgcataattattgatcatcgttttcgtcaggatcttatcatcctcataacgcttcgtcgaactgagctgttcctccataaaagttgttacctgatccatatataaatctatattcggaatatctaccggatgaatataatcaattctgccgacactttccaggatactgtttaataaatcttccgtatttatcgtcattctttttcacctcaatatagatattatatagtattaaaaactagatatcaagtcttttctctatctttcatccaggcttttttaacgtaaatgacgtattaacaattcacttttttctgtttccacatattccgtttatactgaatacatgatttcagaagctctgcagaagtattaacgatcagttcttccggaaaatgactctcctcgatcaccggaagcgcataactgtaatctgcaagatctacatccatatgtgcgtcgcttcccatcgtaaccggaacttcgtatttcttacagtattccagcatttttaaatcatttttcctggtatccacgcggaatccgccaggtcttaacgaaccgttatttacctccagaacggttcctgtctcttttgcttttttggccagctgttcataatccaccggatatcttccgtcatccggatgtccaataatgtgaatcagcggattctccattgccgcaaggtatgccgccgtgattgcctcttccgtccgctcgcctttataacaaggtccatgaatacttgcaattgcaatatccatctggcaaagtgtgctctccggaaggtcaacctctcccttttcattcataatattcagttccacacccatgaacagtctcacgccgtacatttcacgcggtacgatatgcagattctggaaatagaactcatgacaggttcccggcatctgcggtgcatgttcagtcaatgcaaatgcctccagtcctttctctttcgccatctgtgccatctcacgtatcgtattgtatgcatgtccgctgacaatggtatgtgcatgtgtatctaaaactattttcatcggtatttcctcctgcctgctctttgtctgtgttctcacagctcatcttttcttatattcttatgataaactgattctttcttttttacaatccgtttttccccactgttttcatttctaaaatttctataaaatgtgcagtgtttttgttgtcacatggtacaatagactataagaatatttaacgaaagaggtttttttatgaatcttttagcagcacttgcaagtgtacggatctttcccagaaaagtttcccatcagacactgactacccgttggggaaaagctcttgatccgcagcacatactggaagaatatccacgtccgcaaatgatccgcgatcaatatatcaacctgaatggagaatggaattacacagttctttcagaaaaaaataccataaccaaagaaggaactcttctcgttcctttttctccggaagcccctctttccggtgccggtttccagttaaagccgcacgaaaaaatgctctgtgagcgcctgctgtcagtcaagtgccttccttccgacggatcccggtgcatcttgcattttggtgcagtcgatcagtatgcgaaagttctggtaaatggaaaagtagttgtctcacatatcggcggatatcttccattttctgctgatatcacagatgctctgcaggagggttgcaacactctgactgtacacattgaagaccgttccgacacttcttatcacagtgttggaaaacagaaattaaagcgtggcggaatgttctacactgcccagagtggaatctggcagacagtatggatggaatgggttccggctgtctatgtcaaaaaactggaactcacccctttatatgaaaaagagacggtacacgtatcccttcttttaaatcatccgatttccggatgcagcgatgccgaagcggttgtctgtcacgtcagagacatggacggtcgcctgatttccaaagggatctgcaccaatcagtctgactctctttgctgttactcctgctactgtgacgtcaacaatatgcatccctggaatcctgatgatccttatctttatacaattgagatacaagcaggcgaagataaagtcaccggctattttgcaatgcgtacctttaccattgaaccggataaaaaaggacttccccgcttctgcctgaaccatgaaccactttttctgaatggagtcctggatcagggatactggccggacgggctttacactgcaccatctgatgaagcgctgatctatgatatccagaccatgaaaaatctcggcttcaacatgatccgtaagcatgtaaaagtcgagactgcaagatggtattatcattgcgaccgtcttggaatgatcgtctggcaggacatggtaaacggtggcacctacaatgctccgttcatgacctggctgcctgcactctttccaaaattcaagcttcacaccagtgaccggattcatcctctcttcggcaggaaaaatgtacatggcagagaagaattcatccgtgaatgcaaagaaactgtcactgccctaaaagcattcccatgcatcagcacctgggtaatcttcaatgaaggctggggacagtttgattcaaaaaagctcactgccttattccgcgaactggatgacacccggctcatcgattccgccagtggatggtttgacagacggcagggagatttcaaaagtgaacataactactttgcaaagcagttcgtaactccatctgaccgcgctttcgtcatttccgaatacggaggctacacctgccaggtcaaaggacatacctgctccggcaagacatacggatataaaatctgctcttcacaggaagaattccaggcagcctatcataaacttatgtctgaagaaatcgaccccctcaaagaacagggattgtgcggagcagtatatacacaactctccgacatcgaagatgaaataaacgggctgataacttacgacagggaggtttgtaagttgtaggtggttggcaaagttacacacccatggattcggattcacccccgctcgcgcttagtccgcaaacgtagcggatactaagttcgatgatgtctgacgacgtcctctcactaagtaccgacgtttccgatggggttcattccgaatgcatgggtgcttgcgtttgtcgctccagtacaagttgtgcggaggcgcttcgctgccgcactgggaaaatactattttaatttcagtgggataggttgctcaggaacgtaaactttataccttatcaatatacctccagtacttctgcaaatccattgccaccacttcccgtcagacaccacatccaggcgatgcgcagcggatgccgtcccccctggtattagttttttgtgcgcttagtatggtgccgtcttccccccttcgccgatgcggttctggtgtcatagcacagcccggggcagaacgatatttctgctggcgggccctcaaaaaacgccggcacttagtgaggggataacgcttgcggtatcaccgaacttagtaccgctgcgttttttgcggagcgaaagcgcgcccgaaagcagaaatatcgttctgccccgggcgtccctttcctatcacctaactcatcagcaaaatccccgaaaacggcggcaggtccagcgtcacatgcgtccctttttttgcttttgccggcaatgtctttttcttttttgtatttcctccatattcgtcccagtccgtatccagtatcacactgagttttccttcttcttcggtatccagttcgtaatcttcctgttcttcgtctgagaagttgaatatcgcgataaagttcttattttttccttttcttttgatcgcatagatacagcgttcttcctgatggcagtccagccatttgaaattatccggatcataatcatgccagaatgcatcattttcctgaccgatacggttcagttcgatcatataacggtgaaatgcatcatggagcggatattttaggatatcccagtcctgctcgcggctttcatcccactcgcgaagctgaccgaattcatttcccatgaaattcagcttcttaccaggatgcgccatcatatacaggtacatagctcttgcctgcgggaacttatcctcatattctccgttcatcttctgaagaatcgttgcctttccatgtaccacttcgtcatgacagtattccagcaaaaaacgctcattataataatacatcatcgagaatgtcagcttatgataatctctgcttctgtattctggtgcactctggaaatattccagtgtatcgtgcatgaagccaagatcccacttgtaatcaaaacccagtcctccctggtcaaccggtttggtaacacctggaaaattggtggaatcttctgcgatcagcatggctgtcggatgaagggactttagtccctggttcatcaccttcagaaaatccagtgtcgttccgttaacacccctggcctcgtcaccctgccagtagatcagacggctgactgcatccatacggattccgtcaaaatggaactcactcagccagtaatttgctgccgactgtaagaaacatcgtacttcccctctggaatgcatgaaattacagcttccccattcgctttcacctactgccgcatttggatattcatacagacaggttccgtcaaattctttcagtccataataatcgactgcaaaatgtaccggaacaaaatccatgatcacaccaattcctgcctggtgacactcatccacaaattttttcagctcatccggtgttccataacgtgcggtcggcgcaaaaaatccggtattctgatatccccaggatccgtcaaaaggatgctcggaaagcggcatcatctcaatatgagtataatgattcttttttacataaggaatcagaagctttgcaagctcaatataagtataccagtcggtctgcccttctcctttttttctccaggatcctgcatggatctcatagatattgaccggactgtcaaatccaactgtccggttcttcatccatttttcatccttaaatttataactataaagatccgttaagattgagcaatctcctggtcttaattccatctggaagccatatggatcacagtgctctacccttccgccatttgctgtgtaaatgcagtacttatacagctgaccagtcttcgccggaatcggctctgacacatatacaccgctctgtccctcctgatacatcgggatctctgtccagttactgaactctccaaatacgcacactccttttgccgatggcgcaaacacacggaaaataaaattttcaccctctttatgcgctccaaaataacgatatacatcaaaaagatgccctgtataaaactccttccgcatctcttttccccctgtttatttatttttttgaaaagatatgtttgataaaaacatacattacaatggcaaaggccatcagatatccaaacgcaccaattgccggaatcccccacaaccttggctgcatattggttgtacagataatgctggaactgatcagaagtgccatcacccacagccccattacaatattccgcaccaacctccttagcaacccggaaagctcatccgaagtatgaagatccagattgactctggtctgtcctttcatgtgaccctgcaggatgtctgctgcaagggaaggaatatccattgccttgtgaagagaacgatacagtctttttgcatcattctttatctcttttttccactgttccttcgtcagaaagctctccttcatccgtgccgccgcaatctcaaccatgttgatctgcggactgatctcagcaagcacaccttccatattggcgagtcctcttgcaagcatagtaagtccatgaggcatggaaattttattttccttcatcacttccatcagatcctgcataacttccgcaatatcgatatcacccatatcaatcgttccatattttgccatcagattattgatatcttcatacagcttgctctgatccggctttccgcggaactcgccaagtgccatcaccgcttcctggatcagaccgatgtcattctctgccacacctttgactgcattgctgatctgttcccggtcacgctcggtaagtcttcccatcattcccatatcgatccagacaatctttccatcacggatacgcacattgcccggatgcggatcagcatgaaaaaaaccatcctccataacctggcgaatgtaattatctacaagctttgttccaatctcattcagatcatagccatttgccaacagattttctttatcgttgattgcaaatccatcaatatattccatcactagcacatggttcgtcgtatattcgcgatagagccgaggcgttgtaacaaaagccacatcctgattgcgctgggcaaattcttccatactggctgcctccagaaggaaattcatctcctgctgggtgacagtccagagctcgtccagaaccatgttaatatccaccatgtccttgatcgtacctggcgggaccagctttgccgctttgtggagcagactgatatctctggacattaccttatagatgccctgcctctgaactttgacgacaacatcttccccagtcttcagaaccgcccggtggacctgtgcgatcgatgccgatcccagtggatgcacatcaatgctctggaacacttcgttccactcataaccgtaggacttgcggatcacttctgctacctgttcaaatggcatcggtgtcacctcggaatgaagccgcatcagttcttcacaatagcttttcggaagaatgtcggaatgcagtgacatgatctgaccaagcttaatataagtcggccccagatcctccaggatcagccggagcttttccggggtaagtccaccggtaatcccatgttttctgaggactgctgtcatctcccgcagtctggaaccatatttatttgactcttttggctggtttttgttactcattcatgccctcgttgccagattcaattgcttcgacttcttttgctgcttcctctgccgtctctgttccaacagtttcagccgtctctcctgtctgttctacaacttcttctacttcttttgtttcttcttctgaaactgctgcttcacgttcataaattctttctttgagctgttcaatctgctccggtgtcatcttgtcaagcagctcatccagttcttccggtgaagatgtcctgacagaaacattgacattttcttttacggtcttcttgatattgtggcgaagttcctgattcagaacttttccctgttctacagctgcttctccacgttctgccatcttatccagaacttcttttgacttttctgcagttactgctgctgtaccaatccctgcaagtaatactttcttaactccatctcctaagcttcccataacgtctatctcctttcacaatttcaatctgctttaaagtccaaggaatgtaagcccctttggtagaaaaataataatcccggcgatcgctgccataattgctgcaatcagaaccgcacctgctgctgtatcttttgcaatctttgcaagtggtttccgctcttccgtcaccagatcgaccaccgcttctactgcggtattgaccagctccagcgccatgataagcccaaaaagcgtcaggcagatgcaccattccagcaatgagatcttcaatatcactccggcaatcactaccaacaccgctgccgcacagtgaatcttcatattccgctcttttttgatacaggtaccaattccttcaaatgcgtatccaaaactcttatagagcggatctttcttctgactgtccatatttcatcacctgcttcttattattgtctttattttaccaaatcagctctataataaccagtcttttccgtattttctttctatacaatctgtaaaaattgtaaatttgtatttgtattttgtatcgaaaaaagcggaaataccatttctgatatttccgcttctctgtctgtttattttatctctaattcatccatcgttgtttccgtattcattgcaaaaagtacacctccgaggaatcccgggaaaacaatcgcatatcctgcaaatatgatcagccaggatatcccttttaacgccaccagactgacaactccccaaagtgctgcacctatacccccacacaataatgcattcgtcagcagaaaccatcctgtcatactcttttttccatattttttattcttccagaaatcccacagctttctcattttacatcttcctttccaaattccttacctttaacagaatcttatcaaaggtatgtaaaatccaaaggatctgccatgtaaaatctatgtaagaattttaaatcacctgatgcttcagccattttctgctgtggaatctccacgaaaaaataattccacggagtgtccagtctgaaaacattccgatccacacgcccatcgctccgacaccaactatccggatcataaatacgctgaggcaaaaacggcacagccacatcgtcgtgcaagatgtgagcattgaaaatttcacatccccggctgcgcgcataccatagcccgggataaatgccataatccataccaatggctttacaatcgtgatccacatcgtcatatggatacacatatccgcactttctttttccataccaccaaggatcgtgatcggttttgtcagtacaaatacactcagacagctgatgatcagaatcacttccgcaatcatacaaagctttttgatatagtaaaccgcttcatcttttctgccagccccaatacactgtccaacaatcgtcatcaacccaacgccaactccgattgctgcaattccattcagattttccagaatactcgtcattgcctgtgccgcgattgccactgtgccgagcgttgatacggaggactgaatcgcaagctttccaagctggaacatactgttctctactcctgacgggataccgatacttagaattctccggatcatccggaagtctggacggattttcagataatcacgcaccacgatcggctgcctgtcctgacgcagctgggccagaactacaactgcacagaaaacacgtgaaatcagagttgcaagtgctgcccctgcaacacccatatgaaatccccagatcagcattgcatttcctgcaatgttcatcacattggatatcatggaaatgagcatcggacctttcgtattatcctgtgccctgaaaatcgatgctgccgaatcataagctgcgataaacggaaaggacagtgctgtatagaagaaataaatttccgacgcacgcatgacctccgcctccactgatccaaagatcagacgcagcatcggcttttggaaaacaagacagatcaggctgatcacaaccgaaattgccgtaataataaacagcacctgccttgcggattcatttgcccgcttcacattcttctgtccgatatactgtgcacagacgatcgcacctcctgccgccagcgcagaaaacgcctggatcaccagcacattgatcgaatccaccagcgatactgctgaaatcgccgcagatcccacattgcttaccatcattgtgtccgctgttcccatgatggagttcagaagctgttccagaacgaccggtatcagaagatctgcaatcattttatttgtgaacatatgcttttgttccattttcttttaactccctttttcctctgcttctctcttacttcattcctgatttcaaataatttcaaaaaaatccctttgctattatggtcttcttaaactcagaatgcaagtatttttttgccctgatgcgtttaacagacggctttctttctatctcacatagttttcaaacccaaatgaggcagaaaccgcttttttcatacatactttctacctatcagcacatacttatcttatcctgccggcagtttttaagattttcacttttttctgcctgtgccatatcaaataaggaggtccccatgaaaaaagaaaaacattctgatatttcatcccgcaaaaaatccaatcagaagatcatcgattcctacgattatctgtctaatgcagcatctgcgcaggactgcaccggtctgatccctgtcggtcccacaaacagagcagagctggaatcctacgaagaagtctatcattatcggccgccgaaaattgatccggagaaatgtgagtgacttctatcaaccaaataaggaacggtttcgctctttttgtccgaaaccgttccttatatttacgctggtaactactactataacatgaaaaggcatagaacatcctttgtctcattttctacaaaaatcatcccggtaaatttctggtatcctgcctttttcgccatctccaaagaaacccgcaggcgctcgatttcccggctgcgcagcttttcaaaatgttcgatcgtatcttttccttcatagcaatagccctttgttccaaccagggcatattcgccataagaataaaaattattctggagaaatttcagacgttcggaaaacatttccttcatttgcaccaagataaacggtaatcttcatcttctatttctcatcaaaatctacttcaaatacgccttccggtgtcttcatggtcaggattccaagattaaaatcatcatcctgaatcgtgatatgatattcaaacacgacatcatcatcaaatttggaaagtaaaatatattctccattttcctttccttcaatctgatcacagatatcatcgtatacatcctctccggaaatcagtctcggatatccggatgatttgattttcttttcaattgcttcatataattcgttcatgctttctctctctttctttttttcattttatgttgttctttttacgagaatctgatcttacatcttctcccgaaattgcacattttaatttatgctgatttcaacataacatacccgctctatattttctattttgaccaggtcagttcttccttcccggtataatcaaatttaccatcgtttttctcttccagcgccttgatcatatgataggtgtattcattatacggcatcgggattccaagctcttttcccatccgaacaagcgcgccggagaacatatcgatttccgtgtggcatccggcatccagatcctgcaaggtggaatatctggctgacggtggaaccgcacttccacgtccggacgagctttcggtcttactcatatcgattccttttgcctgtgcgactgcttccagctctctttttaatccgtcactgattgctttcatgtgcacgctgtcacggtaacatccaacgcctgctcccagaatcgcctgtggcagattgctgcacacattcaggcaaaacttgcaccagatctcttcctgaatatactctgtggagcggaaatgaatcccggtatctgcaaataactcttccactgctttcacccgctcgctgtcgaacggcgcgaacggttctccgaaaatgattccaagtgtggtcggtggatcaaaatgataaccgtcttcctctttatgtgaagccactttgatcagtgccggtaacacatgctccattcccactgttctgccaatgatctcttcgctgtcaacaccgttcatcagactcatgatcaccgtatgctcgcctgttactttttgtatactctccaaagcaccttccagtgaaccgtatttcaaagcaaccaccatcagatccacatcatgtgcctcatccggagtccacacctccggatggtaagtcttgccattgatcgcacatccgttctttttcaaacgttctgctctttctccttcagcgattactccaagccggatatctgatttttcagaaagaccccagatcacataagagcctactgctcccgcacctaaaactgcaactgattttatcttcatcttctctcacctcgtaaattttctatttttcaacctttcggagtacccttgccggattgccgacgattcccgtctttttcaataaaattccaagaaccatgacaaacgccagagatgctgcacgtaaaagtaccgctgccattttgttgtcctcctgatgtatgttattttctctttatccccgcatcggtgtcctgacttcaatcagattgccgtccagatcataaaaacggatcactttctgtccccagctgtacgtcatcagcctggtgacatatttgctttccggatacagtttttctaatttttcagtaaacgcttcaatattccgctcttcaaaataaagttcacaggaattattctccgggacaacttcttttcctgtaacatccttccagactttttcgtcctgtaaaacaagtccttctgtcagaataacgtttccatcattgtccagaatgatatccagaccaaacagatcatgatagaatttctttgatttttcaatgtcttttacgacaatcaggatattccttaatctcatcttctcctccacaacctgatttttttactctatcagttttttctgatcttcctggtaaaaaataggcttttcctattcaacttcccttcccagtggcacaccgccatggaggatatcttccatcctatgcacacgacgttatccggattgcacgggatttattcgacacctccagtgcaaatgggttcgctttcctggaatagctaccgcaaatacttctgtgtcttttccattacgtttttcaggatatcaatgttttgtaaaatattttctttttccaatgaatgattggcatcctcatacacataaatcggaactgcctgattctttgaacatgcaattactttttttacatcgctccacggatccgcagttccaataaatgcaattgcatcatcatgttcaaacataaaagtctgttcaagcggggtatacaaaatctggcagcattttatcttatatttctcagcataagcggatgcaataatagttcctatgcttttggaaataaataaaacttcactgtactcgtcaaatgcgatttcttcaagctccttttctgcctgcgcatacaagcactcaaatgcctcttgcattttctttttatcgccgcgtatatttttgccattataggaatactcctgcatgactatcttttcatatccatattcctgaaccagttttcttgcatagtacaaaagtggcttatcacaatgataaccaatgcctgggaaaaatactgctattttcatggcatcctcctgatttatcttttatttccatatttatcaaaatttttcctgagtgcaatctccgtcggtatgatcgaacccaccagtggaatcatctgaaatacacacagaattcccccgacatttcctatggcatcattagactttccaataaccagaagtaacacaattaaagataccaccaaaagaataagtccacagatataccagatctttccgcaataatgatgtgcaaatacccaggtgtcctgattcttcattgacattgatgttctgtaaccaaacacataattgatctgatccggtgcttttttcaaaaacatttttccgaagccgatcattgtaaacggaatcagcaaatccattataagcataaaaatccagaatcccataaccgcacctccattattttatcttttttcagtttttctcagatacacacaccccaaatgtcttatgtttcagtttactctcttgggacaaattaatcaacaaaccgttttcggttcttgtgcattttgtggtaaaaaagaaactggaaatttgtgcaaatactggtgaattcggttctctatgcaaatcaatttttaaggcaggactcactcctttcggacttgctctgactcctaatatttcactggtgatcatcaacctgatattgcagggcgtaggtgatggaagtcagccacttatgagcaaatattgcggagtatggtgtttgcgagaattctctcggcagtactggcgttattgctgacaaaatcaaataagtaattacccaatcaattatttatctgccatattactcggataaattatataataaaacaagggacttttagttgcaggttgttctggagtttcaaaatcttcagcggagagcgattggctatcagataaaaacaccaatttcacattttttgcatatcttaaatgagaatgttataccacccaggaggacttatgaaaaaaaattttatatccttactttttgtttctgctataactgtcggccttttatcagcctgcagctctgcacctgccgatgataatgctacgaatcctaaagctgaaaccgtcacttcccaagccaatcatgacaccaattcttctcctgtctctgtgacactgaacgaagtcgcccattctattttctatgccccgcaatacgttgcgattgaaaatgggtattttgcggatgaaggaattaatttgactcttgttactggttttggggcggataaagttatgaccgccgtcctctccggtgaggcagatattggctttatgggaagtgaatcttcgatttatacttaccaggagggtgcaaatgatgtcatcaaaaacttcgcgcagcttacgcagcgcgccggaaactttctggtcgcacgtgaagaaatgccggatttttcatgggatgatctgaaaggaaaagacgttcttggcggaagaaaaggtggcatgccggaaatggtctttgaatacattttgaaaaaaaacggaattaatccacagaaggatctttctatcaaccagagtattgatttcggttcaaccgctgctgcattttccggtgggcaggcagactataccatcgaatttgaaccgagtgctactgcccttgaagcggaaaattccggttatgtcgttgcttctctcggcgttgattccggctatgtcccatacaccgcctatagtgccaaaacaagttatctgaatgctaatccgaacatcatccagaaattcaccaatgccctgcaaaaaggaatggatttcgttcagtcccatactccggaagagattgcaaaagtcattgcaccacagttcaaggaaaccgatctcgctacaattacaaccattgtcagccgttactacgaacaagacacctggaaatcggatctgatcttcaacgaagaaagcttcaatctgctgcaggatattctggaaaactccggtgagctgaaagagcgtgttccttatgaagaactagttacgactacctttgcggagaaggccgcccactaaataaaagcgcagacgcttcattttaagccagcgtctgcgctctattcttacattttaaaatttatccttctgaaactcttaccggatatatccatcctgataagccttctgcttattgaatgtgtacatctccgcaaaggatgcctgtacatacggatttacataaaaaattgcaagaagtccacaggtaaccgcactcagcagataccatccaaggaatgacagatccatgataaatgcttccattttttctccatccatcatctgtttactgatctggaatgcttctttgtaatccattgccggattctcagcaataatatatggtaccatcagatattcataatgcttaacgattccaggtaccaccaaaagcaggctccaaagtgtagtaaataaatctcttaaaaacatggtaagaacaatattaacataatgtccggaacggaaaccgtcaagcaatgttccgattcccggctgtgcagtctggttcaggataaagaaccggtatccacccattttcaggagattacctacaaatacttttgccacaaggacaatcagtattactaccgttgcgattcctgcaagcaatccggtaatcattcccacattaaataaatttccactatatatatctgaattctcacttacccgtcttgcactggattcgccagagactgtgccaaagattcccatcagaagcgcaactacaacggctgacacataattcttcttaaatgccatattgcctctcattttaagttctgctctattccacatcatatacctctcctccttcgaatacattgatatgattctcactacctatactttatcatctgtaaatctgtcaatcactttactgattttctatctgctcagcaagatcattcaagtacacccatctgtccatcttttcttccagtgttgtctctgtttcttctttctctttcataagttcggacaacttcacggaattggtggcattcttaaccatctcccgatccagcttttcgatcttctcttccagctttgcgatatcctcatcgatcgtctcgtattcccgctgttctttataagaaaatttcagctttttttcccgctgcttccaggtctttttgctgtcagactcaccggtctgtgcagaagctgcatctgacatattttctgcaattgtctgtccgtctttcggtttttcaagctccacacggatcagataatcggagtatccaccttccgactggcggattttcccacctccattaaatgcaaaaatacgactgacagtacgatccaggaagtaccggtcatgggatacaatcagaataataccatcaaaatgatccagataatcctccaggattgtcagcgtctggatatccagatcattggttggctcatccaggatcaatacatttggtgcttccatcaaaacacgtagtagataaagtctccttttctcgcctccggataacttttcaatcctcgaccactgcattgccccgtcaaaaagaaatcgttccagcatctgggacgcggtaatcttcccgtcagaagttgcaatgtactcacctgcttcttttacataatcaatgacacgctcggattcatccatatattcattctcctgcgagaaatagccaatcttgattgtctgtccaatttcaatagttccgacatccggttttatgatcccgttgataatcttgagcagcgtcgattttccacatccattatgtccaataattccgattcggtctttcttcagaaaaatataagagaaatcttcgatcagcttcttttctccataagatttgcagattccggaaagttcgattgttttattccccatacgggaagccacagaatccagcattactcgcttttcttcctgaatatctttcatttcctgcatagcatgaatccggtcaatatgcgctttctgtttggtacttctcgcccttgcgccgcggtgtagccattccagctccgtacgcaaaaggctttttctcttacgttctgtggcaagctccatgttctgacgctcggctttcagacgcacaaactcggaataattgcctggatagttatataatttcccatgatcaacttccacgatacgatttaccacacggtccaggaaataacggtcatgcgtaaccatcaggatcgctccccggaactggatcagatattcttccagccattcggacatctcattatccaaatggttcgtcggttcgtcaaggaccagaatgtctgccggtgttaaaagtgcccggacaagtgccactcttttcttctgtccgccggacatatgctcaatcttttcatcataatcggtaaatccaagctgattcagcatagactttgcttctgcctcgatcgtccagcggttcagctcatcataatttccttctgttgccgcgcgaagaattgttgttcctgcttcaaataccggcgtctgcggaagatagcagatcttcacctgattccccatgctgatcgttccggcatcactttcttcgattccggcaacgattttcagcaaagtggatttacccattccgttgactccgatcacaccgattttttcatttttattgattccaaatcccacatcatccagaagcacacgatccgtataggctttggatacatgttccattgtcagtaaattcatatattttcccctgtgattctctgttttgtctttttccattatagcaatttgtacgggtgctagtcaatccaaagtatctcacccggcaccgattctgacacgcaaaaagcacagaatcctatccgttaccggacagtccctgtgctttcacatatccccatattctttttatcttatgatgtgagtgtcaaaaataaattttgccgctcactggtgtaatcagattgctccattgctaaacaattcccgcaatcctcattttataagaaaatatatttcaggataaacagtatcaccagtacatacatcagtacactgatcttcttttcttttgcttttcctgtaagtacgttgattactacataagaaatcactcccatggaaataccttctgaaatactgtagcagaatggcattgccgcgatacagataaagcacggaattccttcgctataatcactgaagttaattcctgccacattgctcagcatatagaagccgacgatgatcagtgccggagctgtcgcaaaggacggaattgcaagaaagattggtgataagaaaagggaaattccaaacaggatcgctgttgtcagggatgttaaacctgtacgtcctccttctgttacaccagaagcactctctacgaatgttgttgttgtagaagttccgagtactgctccaactgtagttgcaactgcatctgccatcagtgcccctttgattctcggaagctttccgtctttgtcaagcatgcctgcctttgtagatacaccgatcagagttccgagtgtatcaaaaagatctacgaaaaggaatgcaaatactacaacaacgaattccagtgaaaatacattcttaaaatcaagctttccaaataccggtgcaaggcttggaattgcaagtccagaactgaaatccggaagcagactgtagaatccgatctccggattcggtacataaagacctgctatctggcagatgattccaagtatccatgtgatcaaaataccccagaggatatttcctttgatgttcttaatcaccatgattgctgtgatcagcacacctatgattgcaagaagtacagtaattccaacgttattgaagcttgcttccactccatttgcctgattatatgcatctacggagaagagctgtaccagagtagatcctccgacaacgatattggcattctgaagtccaagaaatgcaataaataatccgataccaacgctgactgctgtcttaagacaagttgggatcgcattgaagatcgcttctctgacattcgtcagggaaagaataatgaaaataataccctctgcaaatactgcagtcagtgcagtctgccatgagtagcccataccgattactacagtataagcaaagtaagcattcagtcccataccaggtgcaagtgcaaatggataatttgcgaatactgccatacacagcgtaccgatcagtgatgcaagtgctgttgcagtaaagactgccccctgatccatacccgctgcggaaagaatgcttggattgactgccaggatatacgccatcgtcataaatgtcgtaatacctgcaagaatctcagttttgacatcggtgtgattttctttaagcttaaacacctttttcaacatattgttttcctcctgctgtctgtctcggatattccctctcactccttaaaatatcctcgtacaattttcttgtagcagagaatattttagcaaaaaaaagagagaaagtaaacacattactttctctctgatttctaactcttattcgctattactgttcatagtagctatataccgcaactatttgctctctctgatcttctttctgagcggaagtaccattgcaggggatacggataattcgtctaatcccatgcttaagaattcttcagtcagttcgaggtcagctccgagttcgccgcagattccgatccatttgccttctgcgtgggcattttcggctgccatgcggatcattgcaaggactgccgggtggtgcggatcgtagaaggcatccagcttctggttctgacggtcaattgccagcgtgtactgggtcagatcattggtccctacgctgaagaaatccacttcttttgcaagctcacggctcatcataacggcagccggtgtctcgatcatgattcccagttccacatcctcacggaacgggatctgtgcctcacgaagctcttctttgacctcttcgatgatcaccttgatctgcttcacttcttttaccgaaatgatcatcgggaacataatggcgatctgtccgtaagcagatgcccggtacagggcacgaagctgggtcttgaagatctccggtcttgtcaggcagatacggattgcccggtatcccagtgccgggttctcttctttgtcaagtccaaagtaatccacctgcttgtctgctccgatatccagggtacggataatgacctttttgcctgccatattttctgcaacctgtttgtatacctggaactgctgttcttcagtcgggaaatcttcgctttccagatacaggaactcacttcggaaaagtccgatccctcctgcatcatttttaagtacggcgcccacatcggaaagattaccgatattcgcatagacattgatcttctgtccggaaagggtgacattctctttgcccttcagttcttccagaagtgttttctgtctgcggtcttcttcgcgcttttcggtcatagccttcatggtctcttcatccggatcaatgtagatggtcccggtaaagccatcaatggctgccatatgtccgtcatattcttttgcaagcccttctcccaaaccaataacggccgggatgttcatggtccttgcaaggattgccgtatgggaatttgctgatccgtacatggttgcaaatgcaagcactttggacttgtcgagctgaacagtctcactcggtaccagatcatctgctgccacgattaccggttcatctgccacaacaccgctttccccggcatccgaaaggataccgagaagtcggtccgatacatcttttacatcggccgcacgtccctgcatgtaagcatcatccatagatgcaaacatccgggagaagttatctcctgtcgtcgcaacagcatactctgtgttgacttcctgggtggtaataatattcttaatcgaatccacataatccagatccatcagcatcatctgatgtacttcaaaaattgccgcattggcttctcctacatcttccattgccttgtcatacaactcaccgagctgtgcgatcgcagtctcctgggcatcctcaaaacgtgccacctctgcttcggtatcctctacatgataccgtcttacctgcttttcctgtcttttataaaaagcaatcttcccgatggctacgccaccaaaaacacttttaccacttagtgtaatcataatcctacagattctcctctaatactttctggatttcggcgattgcgtcttcttcgtcttcgccttcagctgtgatgataacctcatttcctttttttacgccaagactcataactgccataatgctctttgcattaacttcacgtgtatctcctgcttttttgatcttaatatctgaagtttttttcgcaattgcttttaccagaattcctgccggtcttgcgtggattccctgtgcatctgttactacatacttaaattctttcatgattcaacactcctgttctttaaaaaatatttagaaaattaataagttactgctctgctttcaatggctttttgagtaatacaattcccgccattgctacgacagctcctacaaccaatgctatcaaaaacatcaatggattgtcaataattccgatgacaaaaattcctccatgcggagctcttgatccgcatccaaacatcatggataatgcgcctgctattgcagaaccaaccacacatggcggaatgattcgaagcggatcagatgctgcaaatggaatggctccttctgtgataaaagaaagtcccataatgtagtttgtgatacttgtctgctgttcactctttgtgaaacggtttttaaaaaatgtggtggcaagtgcgattgcgatcggtggaaccatacctccgatcataacagatgccataatatcaaactgtccacttgcgatggatgccgttccaaatacatatgccgctttgttgaacggtccgccaaaatcaatggacatcatacctgcaagaaccgctcccagaagcatcttgctggattctcccattccggaaaggacattattcagccaggtgttaaatgctccaaccggtgggtttacgataaagatcataaatgctgccatgatcaggatcccaaagaatggatacagaagaaccggttttgtcccttccagagttttcggaagcttgtcaaacaatttcttcaatccgatcatcaggtaccctgctgcaaatccggcgatcagtgcaccgaagaatccggatgaaatccatgcgtcttctgcaagaaatacagaagttccggcttttgcaagaagtccgcctacaataccaggcatcaatgccggtctgtcaccaattgccattgcaatataaccggcaaggatcgggaacatcatcccaaacgctgtatttccaacggtgttgaagaattttgcaagtggagttccactaccaaatgctgctgtacctgcatttgcaccgtcaaccaggaaagaaagtgcgatcaggattccaccgccgattacgaacggaagcatatgggatactccattcatcaggctcttataaatcttgcgtccgatggtatctccgtcagatgacgcaccaccctcttctgttgctccacccttgctgtgataaactggagcgtttccactcaaggcacgttcgatcagctcctgtgctttgttgattccgtcagatacctttgtactgatcaacggcttgccgtcaaatcttgccattgcgacatccttgtcggctgcaatgatgatacagtcacaggcagcgatttcttccggtgtcagtacgttcttggcaccaccagatccgtttgtttctaccttgatggtaactcccatttctttcgctttcttttccaggccttccgccgccatgtaagtatgggcgataccggtcgggcatgcggtaactgcgaggatctgatacggttttgcagatgcatccgccggagcttctgctttttcttctgcttcttccgggaatttttctttctcggctgcatcaacataaacaagaaattcatcaacatcctttgcatgaagcagcttgtttctgaaatcctcatccatcagaagcatggacagacgactgagtacttccagatgtacattgtcctctgtattcggtgctgcgatcaggaaaataaggtataccggttctccgtccagagaatcgtaatctacaccctccgggagtaccatggctgcaagtcccggtgcgcttaccgcttcagtcttgccatgcgggattgcaatgccttcaccaattcctgtagttccttcttcttctcgtttaaagacggtttcacgataggtgtcaatgtcattgatgttcccgccttctgccatcagatcgaccatttcacggatgacctgctctttggagtctgccttgccatcgaggcaaatactttgctttttaagtaagtctgtaatcttcatcttgtcattcctcccatttgattttatatatggtacacttctgccggttctccaagaagcgcaacaatctcatctcttgtagcgagccatgaacagaatgccgaagcacttcctgccgccacacccaggcggaatgctttttccatatcttttgtattcagatatccggtaataaatcctgccaccatagaatcacctgcgccaacagaattgacaacctttcctttcggaggcatggtctcatagacttttccctcctttgtcacaaggatcgctccgtcacctgccatggataccagtacatgctgtgctccaagtgcctgtaacttcttcgcatgaatgatgatgtcttcttttctcttcagttctacattaaacatctcacctaactcatgattgttcggtttgatcaggaacggatgatatttcataactttcaaaaggagatccttcgttgcatccactacaaaacggattccttttccggaaagtctctccaggattctctcataaatatcttccggcagagtatttggaatacttcctgcaaggatcagtacatcgccttcttccagcttatccagcttttcatacaatgcctggatcgcttcttctgtgataaccggtccctgtccgttgatctcagtctcagttcctgcattgatctttacattgattcggctgttgccttcttttaatgggataaaatctgtctcacatccgaactcttccagcatcttttccagtacatctccggtaaatcctgccttgaatccaagcgctttgctcttaagtcccagattggaaaggatcacagatacgttgtttccctttcctcccggatagatatgttcgcttgttgtccgattaatctctcccgggatcagttgatctgtctgtaccacatagtccagagacgggttaaatgtcactgtgtaaatcattattttgcaacctccacaatatttttatatttgttaaatgtagcatccttaagctttgttgtaatgatgtccactgcatccagttctgaaaatgttaccggtgctacctgaccgaatttggttgaatccgcaaggatgtaagcctttgcgcttctcaagatcgccatctctttgatcgcagcctcccggatatccggtgtggtgcatccactctctatatgaatcccattggttccgaagaatccttttgtgaaatggtatcttcccagggttttcattgcttcctctccgaccagtgccagcgttgcttcttttaattccccaccgatcagataaactatacaacctttctgtgtcagcttcttcgcatgcatgattccgtttgtcacatacacagcgtcctgctctgtcaggaaatcaatcaggaaatccgtggtcgttccggcatcgatataaacaaaatcatctttttcaatcagagatgatgcatactttccgatctgcaccttttcatcaatgttcagatcctgtctgactgcaacagattcatctctggtgtactgcgccatattgactgcggttgcaccaccatgtaccttgatcagctttccttttttatgaagtgttgtcagatctcttcgtatcgttgactctgacatatccagaagctcggtcagttcctgaacagtgattgtcttgtgttcattcactaatttcagaatttcactgaatctttcttctgcaagcacttatctcacctccatttcgactggttatgactgatttattcaattgtattttatattccagtcattttcaatcatttgttttctttttcattcatctttaggtctaatatatcgcctttttcagtcaaagtcaatcattttcaatcataaataactaccaaaaaaatagggatgattttgtgcatttttatgggtgtggaatcggtggtgccagagttccgacttgtgtttcatctccattgcactcaacggaattggaaatggatatagtcggaacggaactctggcttctacgttactggcaaaatgcagcaaaaggctttgtttaacctaaccaaatgcaaatttatacttttctcttatatgcaaaaaagccaaagcacttttttaagttatattgaatgataacttatctttaagtactttgactttttatttaggcaaaatcaaacagggataactgattggtctccgggaggtcgcccagcaaacccatatctgccatcaagtcaaccaatgtcttgctgacttttgttctctgacggaaatcgtctttagagaggtatggtccgtctttagcggcaatttccatagcctcggcggctttatcgcccatgccgtcaatggtgttgaacggtggaaggagcttgtcgccgacgatctggaacttggatgctttggatttgtagatatcgatcggtaaaaaatcaaatcctctggcatacatttccagtacatttttcatatcttttaaggtatcctgatcttttttactgagctgattgagttctgctcttcttttatattctttcatatggtagagaagtttttcttttccctgtcccatcagttcgtaagagaatgcagatgcacggattccgaagtatgccgcataataagcaagcggataattgatcttgcagtaggcaattcggtatgccatcatgacataagctgcagcatgggctttcgggaacatgtatttgatccgctcacaggaccagatataccattccggcacgtcatgctccagcatatcttttttaaactgtgaccactctttacattttccttttgcgacggttcctttacgcacacgttccatgatcgtgaaggattcttcactttcaacacctttgttgatcagataagtcatgatatcatcacgggtacagattgccgtggaaatggttgcctttccttcttcaatcagggtctgtgcattgttcagccacacatctgttccatgagacagacctgaaatacggatcaggtccgaaagtgtctttggcttggtatcaattaccatctggataacaaaatctgtaccaaactccggaactcccagacaaccaagcggacatccgtcaatgtcctccggcgtgataccgagcacctctgttcctgcaaaaagtcccattacacctggatcatccaatggaatatcagtcgctttaaatacattattcactccatcgtatttattgtccatcgcatcggaattgatcagctcttccagcgttttgatcatggtcggatcatcgtgtccgagaatatccagtttcaaaaggttgtggtcgatggaatgataatcaaaatgagtggtgataatatcggtcgtcatatcatttgccggatgctggattggagtgaaagagttaatgtcctctccatgcggaagaactacgattccccctggatgctgtccggtacttcggcggattccggtacagccagctacgatacgatcgatctcgcagtttcgcttacggtcaccacgctcctcataataattcttcacatatccataagccgtcttttctgcaagtgcggcaatggttccggcacggaaggtctgaccttttccgaaaataacctccgtatacttatgcgctttactctggtaatctccggagaagttcaggtcgatatccggctctttgtttcccttgaatccaaggaaagtctcaaatggaatgtcaaatccgtctttgaccagcttctgtccacagaccggacagttcttatccggcatatcgtgtccacagccacccacatattttttcacttcttccgaatcaaaatcactatagtgacaattgctgcaatagtaatgtggaaccagaggattgacctccgtgattcctgccatagttgcaacgaatgaagatcctaccgaaccacgggatcctaccaggtaaccatcctcgttggatttccataccagcttctgcgcaatgatatacataaccgcaaatccattggaaatgatggaattcagttctctttccagtcgttcatgtacgatctccggaaggggatccccgtacatagaatgggctttattataacagatatctcgcagcatctggtcggaattctcaataaccggaggacacttatccgggcggaccggagaaatcttctcgatcatatccgcaatcagattggtgttcctgatcacaacttcatacgctttttccgaaccaaggtaggcaaattcatccagcatttcctccgttgtacgaaggtatagtggtgcctgcttatcggcatctccaaatccttttcctgccatgataatccggcggtatacctcatcttccggatccatgaaatgtacgtcacaggttcccacgaccggtttgtggaactgctccccaagatgcacgatcttccggttcagatccatgatatcttccatagaattgaccgaagttactttgtcactctctaccatgaatgcattgtttccaagcggctggatttccagatagtcataaaaatccacgatcttcgcgatcgtctcatccggctttccatccagaagtgcacggtaaagctctccggcttcgcaggcacttcccacgatcagaccttcccggtgctcatttagcacacttttcgggatacggggtctgcggttatagtaaaccagatgggatgcagaaacaagctgatacaaattcacacgaccaatgtcatttcttgcaagaataatgacatgataagtcggaagctttttaatagaatccgggttcagatccccaaattcattaacttttgcaagcgttgtcagttcccgttctttgagcatctgcacaaatttcacaaagatttctgccgtgcagcctgcatcatcaactgcgcggtgatgattctccagggaaatatttaaagcttttgcaacggtatccagcttgaaacggttcagtgccggaagaaggacacgggcaagtgcaacggtatctacataagtaaaatcagcctcaatcttctgccttttgcagttctgctcgataaatcccacatcaaaagaagcattatgcgccaccagaaccgcatcgccaataaattctataaactgcggcaagattgtctcaatatccagcgaaccgatgaccatctcatcggtgatgccggtaagttccgtgatacggaacgggatcggacgtttcggattgacaaaggtactgaacttatctgtgatcttcccgtcttccacttttaccgcgccaatctcgatgatccggtcagtcacagctgaaaaaccggttgtctcgatatcgaataccacgtaagtgccttccaggtcctgtcccttttcgttctccgcgatcttagtcagatcatctaccagatatccttccactccataaataactttaaatggatcatctttatccagatcctcgatcacatgattggcatcggtaaacccctgcaccacaccatgatcggtgatcgcaatcgccgggtgtccccagtcatgtgctcgctttaccagatcttttgcctcggaaacaccatccatatcgctcatcttggtatggcagtgaagctccacgcgtttttccggatacttgtcttttcttgttacacggaaatccgaagttttgcggattccggttacagaaccaatggtcagctctccatcaaatttatcaatcgtcgtaactcctttgattttcagaaatacaccttttttaatctccgcaagcagatccgggagctggtcattgcgggtaaacatcttgaccatgatcgtgtcggtaaagtcggtcacggcaaacatgacgattgtcttttcgttccggatctcacgggtatcaaagctgatcacctgtccccggaaagtaatctcacccatctctccggtaactgtcttcagctcgatcggcatatcgtcaaagtcccgtccatagattacgttcgggtcatcggagcgcttgagcggataatcccgacgcacaaagcttcccttgccacttttgaacccactggactttcctgcaaattcctgttttttcggagtctccggtttcttctgttcctgtttattctgcgtacttgatgcatctgcttctttagcggcatcttctgctttttccgctttcttctttgatacgccttccgtttcttttgcttttgccgcctcttccgtggcatgctgtgcctgcagcttctgattcctttccctgatcgcatctacttcctgttgaagctgcatttcattgaatttcttgtatttgctctctcctacttcttcataatcaatttctacatccaccggcacgtggaaacggttctcaaagacgtccttcagatagctggtgatctcgctggtctttccctctgcaacaatcgtgtccgccatagtcagacacatagtacgctccccttcgaagcggcactttgccttctggaacatatttttctccagcacacttttctgctccagctcaaaaagaatactctccttgtaggcatgcatcaggttctccggcgtatactgctcggaaagccggtattcctcgatgatcgtcaccggaatatttccctgcgaaaacagctgttcctcaatctggttctccacataacataccgttttcttcgggatcagatgggtactgtaaatataaaccttgatatgatttctggctgaagtggaggtgattttcgtcacctccaccttttcaaacaacatatggctgtcgttatcgatattcaatgttggaaacacatcaaaaaatagctttgtcatcttctattcgccccaatgttccagttcattacgaagtgcatctaaaagctcatcctcttttaccttacggatgatctctccttttttgatcagaagtccttccccaattccccctgcgattccaagatcagcctctcttgcttctccaggaccatttaccacgcatcccatcactgcaaccttgatatcaagtggatattcagcaaccatcgtctctactttattggcaagtccgatcagatcgatcttggtacgtccacaggtcgggcaggatacgacttcaattccaccttttctaagtcccagtgctttcaggatcagttttgcactcttgatctcttctaatggatcccctgtcagcgatacacgaatcgtatctccgattccctgataaaggatgattccaagtcctactgaagatttaatattgcctgaaagcagcgtcccggactcagtgattcccacatgcaacggatacgggcatttctttgcgatcagctcatgcgcttttacacacatcatgacatctgaagacttaatactgaccaccagattgtcatagcccatgttctcaatcatgtgtaccttgtcaagtgcactttccacgattccctctgcagtcacgccaccatatttttccagaaggttcttctccagcgaaccactgttcaccccgacacggatcggaatctcgtattcttttgctttctccacaaccgcacggactctgtcctcacttccgatattccccggattgatacggattttatctgcaccgttttcaattgcagcaatcgcaagacgataatcaaaatgtatatctgcaaccagtgggatatgaatctgctttttaatctcttttaaagcctgtgccgcttccatggttggaacagcgcagcggatgatctcacagcctgccttttcaagcgcaagaatctgcgcaaccgtagcttccacatcctctgtctttgtattggtcatcgactggatcgctaccggattgcctcctccgatctttcttcctccgatatttattacttttgtatccttccttgtcatctgattttaacctcctgttctcacacaaaaccctctgtccgcggactttcatgcccacagagagagggttctctttatttgcctgctttttcaaaaatcatctggtctccataatcccactcggtaagtgtaagcttggttccgtccacactgtaattgaatgtagtaagtacagaattgatcgcctgctctacttccgttgcagttacattatcaccaagttctttcgctgtctcatccagctcttcctgctttacagtaaatgtaatctgctttgccttgatatccagtgtatatccaagttccacatccacatccttaccatcgatcaggttcttccagtcaagctctgcttcattatggtcatctacttccagtatcatatcactctcatcatgtttccactttccttccagcggatttccgaaaaatccctggtaaatgaaatatccagccacgataatgatcagaacggtcgtaattcctgtcacatagttccacacacggcttcttttatcttcatcattctttgcaataatcatagaatcaagccctccacatcatgtcaatcttataattcattatacgggttttaactttcactgtcaacggggactgcaaagaagaacaactctttaaaaagcaaaaaggaaatccactataacgcagatttccttctctaatatcataaatatccttatttagcacgctttcccttcagatccaaacagacggatcttttcggcaacaactttcttcattgcatcgatctcatatgggataagccccatcatggttctctctcctgctgcaattccggcttccacaccggcttttcccgctttgtcgatatccgtgaaaatattgactttggataccccaagttggaccgcctgacggaaatcattatctgcaagtccggaaccaccgtgaagcaccagtgggatattgactttctttgaaatcacatcaattctgtcaaaatccagtttcggcgggaatgcatagtctccatgtgcatttccgactgcaactgcaagagaatctgcacctgtccttgtaatataatccagtgcggtatccggatctgtataataatcctccggattctccaactttccggctccggcattatcgcctacatgaccaagttctgcctctaccgttactcccattgcatgacagattttcaccatctcagccactctttctacattttcttcataggatacggttgagcagtcgtacataacagaggtaaatccaagctttaatgcttccatacaacgctcaaatgtaagaccgtgatcgtaatgtacacagatcggtacacttgccttctttgccatcgggatcaggtaatctgctaccagattcagttccgttgccggaagaagaacctccgcagttccaaccataaccggtgcccgaagctcctcagctgtctcgatgatcgcacgcgccatctcgatattgactgcattaaaaaatccaactccatattttcctttttttgccggaagcaaaatgtcattcatatttactaacatactttttcccatccttcctcgatttttttctttaattcttcaaatgatttcagaccggataaagcgtcgtaagcggcaacacagctggctcctgtcgctgctgccagatgcagacacatttccggagtgtttccttccagcattgcagtaagaaatgctgcaatactggtatccccggctcctgttccggaaagaattttttctggtatatagctcttttcaaagactgctttttctgcccaggctgccacgtcaagctctgtacgcacacttacctgtctgagtttttcttctcctgcggtctgcaaatacattccttttgctccgcatttcagaagaagtactttgcatccaagcgtaatacatttttctgccagaggcttcacatcctgttcaatatccagcacatctgtgatatctccaccatccgcacgtacctgcaattcttcgaatttatcccggtcaagcatgaaacagagttcttcaatacttggtacaaagaaatccacataaggaagagttcttccaagaatctttgcccagtctgcctgtcctgcttttgaatttgcatcgactgctgccagatcgagggacgttgccgcccctgtctcctggacagatttcatcagatgtacaagctctgctccatcattattatacatcgattccatcagtgtcggatatccaaaatgaaaaattgctgcttctttcactttgtcaaaatcaatatctgataccgcaaaagtatggtttgctcccggatgatgaaggaaaatccggtcaatcccaggaattgcaagcacaaccgaataactggttgttgattccttatcacggatcattccttcttttgcatcatatccgtccagtatgtttaaaatcatgtcgccaaatgcatcctcgccgacttttcccataagagagacgtctgcacctaatagtttcattgcaagtccggtatttgcaacggcaccgcctgtgtgcacgtcagcatttcccatctgtattaacttacccgggcttaagacctgctctacactttttacttttccatctggaaatacaggcgtgatatccagacagatatgtcccgctacaattaccttctttttcattttctcttattctactcccatcagaagattcattacatacatttcaagtgcttcaaaatctctttcttctacgcactttttctggaaatcatagtcgaatttgtctacttttgcttccagtgccttaaagatctttaaactgttttcaagatgcttataactgtcttcatccttagttgtacgcattgcttttacatcaagtcctacatactcaccatgttctccgtatccgttctctttcaggacttttacctgattgaatgcctgacggaggttttcaacaccaaatgctttatcctgatcataacggatgctgttctggtcattgagatggacagtcatcagcttgttcattgcaagtgcaaatccgatttcatgtgccgggtcaagtcctgcaaggattgcatgtgcactttccaggtttccccccacacgggaaggatcgatagtagctgctgaaattgccatgacatgtcccatggttccacagatacttctgtcgattggttcatttggttttggctcaatgcacacacgaatctttggatcatattcaagcatcttgttgatggcttcaatcagcattttggttgcccatactggtgattttgattctgcacacagtgtgccttctcttgcaagccacagaacgatcatgtctgttccaagttcgtttgcaatatcgatggaacggtatgctctccacattgcgtattcccggtcttcttttgatgtgctcatgaatccaccatcctgtgtatgtggatccatccagagtcttggtgctacgaattctgcttttaagttatatttatcaagtgtctttttcagctcacgtgctttttctttgatttcttcttctgtataatcattgatgttcggtacagcgtcatcatcatggaactggattgctgagaatccgatctctgcaaattttttaaatttctcctcgatcggtatgtcttttcttgttgccggtccatacgcgtctgctcctgtatgtacgttccaaggtcctactgaaaatttaaactgtgtcattttaatttcctctctttctttgattttaactcgagtcctcaacgtttatctttgatgatctaatcataccagtctcatagtacaaaaaaatgacaatgttgcgattttatctgtaacttcttgcttacctgtgttatgataaaaacaatttaaaaaagagaggaaactgttctatggaaaagaaagaaatggaaattgtaagacatactacaatgaatcatctggaggtttttattgttgaaatgacctcccgcggtccccatggacatgatgattttgaacttggaatgattcttgaaggaacaatgacactttttttggaacaggaacagtatcatctgaaggccggagatatttattttatcaaccggtatcaagtacattctttttccaacaaaaccgggcggaaccgcatcctggctttccagatcgattctgatttttacaagcatattttttatcagtcaaaatttcttcattttgaagataccgttttttgcaacggtccattttatttacagctccgcagactgcttctcaactgcgcacgctgttattttagtgaaactacatacaatgaattaaaatgctctgaacttctcatcgagattatgtatcagctgctcacaaacgcacgtccttcttttaccagcgagaaagagtacaatgctgcgcagacagcctcccaccgcatcaaccgcatcacggactacattgctgagcactcttctgaaaaaatatcgcttcaggacattgctgatctggagcacatcacaacttaccatgcttcgcattttattaccaaaatacttggcatttcctttcaggattatcttaataatgtacgctttgagcatgcactggagctgatccagaattcagatctgtctattctggatatctgtatggaaaccggattttccagcagccggtatctcaacaaactattcgaagaaaaaatgggctgtaccgccagagaatatctgaagacatcaaaaaaaccgcaccttatcgatacggttcttcctacggataatatccagaagcgttattcgtttgaacagtctgcatttattctgcagaaggttccggattagtttgtttcgtattttacctgaaaagccgtgctgtcggatcttgcgacaacacggctttcacctgctctcttatctatgctttaattgcatcatcaaatgctacatcggacggcatgaaattaattttcttcgtaaattcacaggcttcttttcctccaaagtttctctgcataccactgtcttcccattcaacagaaagtgggccatcataaccaatctgattgagtgcacggatgatgttatcaaaatcaacgtctccatgtcccggcgatacaaagttccatcctcttctctgatctccaaatgtgatatgggatcccagaatgccatttcgtccattcagattcagttttgcatcttttacatgcacatggtaaatacgggctgcaaaatcaaggataaacactgccggatccagtccctgccagatcaggtgacttgggtcaaagttgattcccagtgtcggtctgtgttcaaatacatccagtaatttcttggtactccagtaatcaaatgcaatttctgtcggatgtacttcgagtgcaagttttacaccacatttatcaaattcatccataatcggactccacaattcttttactttctgatagccttcttcaatcatctgctcggatgtctgcgggaaagaataccagtatttccagattggtgatcccataaagaatgttacaacatccacgcccattgcttttgctgcatgtgcggtcactttcatttcttcaattgcccacttctggatttcttccggttttcctgcatattctgctggggcaaaaccatccagtctggaatcgtaaatagacccgatactgtcaaccacacactgtcctgccagatggttactgattgcccagcatcccagaccatattttttcagagtatctttcacttctttgacatattccggatcacttgccgcacgtttcatatccagatgtgatgcggataattctaatccttcatatcccatctcctgtgcctgtctgcacatttcttccaaaggaagatctccccactgaattgtaaataatgttaccggtctcataaaccattcctcctttttaaagttctacccagacatttccgttctgactgctcttaagacatgcctctacaaatgcaagtccttcaactccatcttttacggttggataatcaatcatctcttctgtaaaagttccctcttcttttgcagaaacgcactccgtaaagcttcggtacagatttcccattgcctctagccagccttctgtatgaccagccggaagccttccgtattttgcagccttcgaatcaatatctccatatcctctgtgtacttcccggattgttccattcttatcgatcactgtaattttttccggcgtctcctggaaccagagaatcgttccttcacttccgtaaatacgtacacgcagactgttatcacatccaattgctacctgtgaggtccagaaaattccagttgctccgttatcaaattcaatcaaaacagaatcattatcatccagttttcttcctggaacaataacatccatctttgcaagaagccgtctgatcttaagtcctgtcatcgttgccactgcattttctacatgggttcccagatcacccagacagtttactccacccgactgtgccggatcacagcgccattcgccctgttttccacccacattgtcttcaaatgcaagccatccctgcggatattctgccataacagcacggacatctccaattgcaccagaagcaatcagatctcttgcatactttgcagtcacatgtcccatataagtataggtaaccatgaataacagtgatttttcttctgcaagtttttgaagttccactgctttttcataggttgttgttaccggtttatcacatactacatgaattcctgcattcaaaaatgctttgcagatctcataatgtgacgcatttggagtaacaactacaacaaaatcaatgccgtcttcccttttcgcttcctccaatgccatcgtttcataatctttatagcaacgctcctcttcaatatgcagaacttcccccatcttttttgacttttctgcatttcttgaaaatacacctgctaccaatctagcactttcatccaatgaaattgcccttctgtgtgcatccccgataaatgcatccggtccgccaccaaccattccgtaatttaatacttttgccataatttctcctttctgacattgcatctatctttctcattattttgataatagcacctttattatttgtaaaaatgataatcttgcgatttttatgtgacaatttagcagtatatagaaaagcgtcagccacaacgtgactgacgccataaatacattctatttttattactggatatgcggaaataccggtttgagtgccggataaatctgacggaactcctggtatctcttttcgtatttttcaaccagttctgcttccggttctacggtatctacaatcttaaccagcttgtctgctgctgcttctacgctttcgtattcgccgcatccgactgctgcaaggattgcacctccaagtgccggtccttcttcgctctcgatgatatccactttcaggttcatgatattggcaatcatctttctccaaagaggactctttgctccaccaccgcagatcttggtacgttcaatcttgattccaaggctttttgcaacttcaagggaatcacggagtgcaaatacaactccttccagtactgcctgcatcatatctgctcttgtggtatccatcgtcataccggtaaaggtagctcttgcatatggatcattgtgcggtgaacgctctcccatcagatatggaagatagaacacatggttctcacctagctttgtaatatctttctgctctgctgcaaaatcatccgtgtgaagaatctcttctgcccaccatttattgcaggatgcagcacttagcatgcatcccatcaaatgataatgaccgtctgcatgtgcaaaggaatgcagagcattgttcttatctacgccgaagtttgcactggaaataaagatggttccggatgttccaagggaaatgttacatcttccgtcaccaactgttcctgttccgacagctgccgctgcattatcacctgctcctgcaataatttttacattttcagaaagtccgagttctgctgctacttccggcttcagatttcctacgacttcgtaactttcataaagcttcggaagctgttcttctgttacgccgcagatgtccatcatttctttggaccagcatttgtgttctacatccatcagaagcatgccggatgcatccgaataatcagagcagaagcttcctgacaggcagtatgccagataatcttttggaagcatgatctttgtgatctttgcaaaattctccggctcatttttctttacccacaggatcttcggtgcggtaaatccagtaaatgcaatgtttgctgtgtatttagaaagcgtttcttttccgatctcgttattcagataatccgtctcttctgtggtacgtccatcgttccagagaattgccgggcggatgacctggtcgtctttatccagaatgaccagtccgtgcatctgtccaccaaagctgattcctgcaacctggctcttatcacactcagaagtcagttctttgatgccttctacggactgggtaaaccagtcttccggatgctgttctgaccagcccggatgtgggaagtataatgggtattcttttgaaacaatttttttgatgtcgcctttttcatccattaacagaagttttactgcggatgttccaaggtctacgcctatatagagcatgatgtacctccttgttagggtttttgtatcaacctgacggattcgagggattgtgaccagattatagaaaataaatattgcatcttccaattggcaaagcattccgatgagcctcttagggcggaaattgtgtcagcaacggcttccacaatttctgagtctcatcttcattgcctcaaatggaatctgccatatttattttctataatctggtcctcaagacattgaaccgcctgcttgaaacataaatcctgtttttaattcgtgtttctttgtactataaaggggcgggttcattcagccgccccttatatgattgtgtatagttttaattagccccaaggattttctgttgggtaacgtacaccttttggctggttgtagccgatttcgtctaccggtactccgatgtatttgaatacttcgtaaagtgcttttccgtaatgtccgaatgctacggctccgtgatgcgggaagttcttttcgatcagtacatgacgatagaatctgcccatttccggaattgcgaagattccgattgctccgaaggaacgtgttgctaccggaaggacttcaccgtgtgcaatgtaagctctcagtatattatctgatgtgctctgcagacggaagaacgtgatatctccaggtttgatatctccttcaagtgttccctgtgttacttcgactggaagagatcttgccatgatcatctggtatttcatttcgcagaatgaaagtttggatgatgcagtatttccacagtggaatcccatgaatgtatctttcagtgtgtaatcgaatttgcccttaatgtcttcttcataaaggtcagccggtacagagttgttaatatcaaggagtgttacagtgtcttcacttacaactgttccgatgaattcgctgagtgctccatagatatctacttcgcaggataccggaattccctgtgctgtcagacggctgttgacatagcatggtacaaatccgaactgtgtctggaatgcaggccagcattttccggcgattgcaacatatttgcggtatcctctgtgttcttctacccagtctttaagtgtcagttcatactgagcaagttttgaaaggatttccggtttcttgttaccggctccaagttcttcttccatctcttttacaattgccggaattctttcatctccggcatgtttgttaaatgcttcaaacaggtcaagttctgagttttcttcaatctctacgccgatattgtaaagttgtttgatcggtgcattacatgcaaggaaattcagcggtcttggtccaaagctgataatcttcaaattgttaagtccgatgattgctcttgcgatcggttcaaattcatggatcatatctgcgcattcttctgctgttccaaccggatattccggaatatatgctttaatattacgaagctttaagttgtagcttgcatttaacataccgcaatatgcatctccacgtccctggatcaggttgttgccgctttcttctgctgctgcaacgaacatctttggtccatcaaagtgttttgcaagcagagtctctgagatttccggtccgaagtttccaagatatacaaccagtgcattacatccggctttcttgatatcttccagagcctgtaccatatggatttcactttctacgatacagatcggacattcgtaaatatgttcttctccgtatttttctttgtaagctttcataagtgcttctcttcttgatacagaaaggctttccgggaagcagtcacggcttactgcaacaactccgattttcagttctggcatgttattcattgttttttcctcctaaaatatgaatctgtctgttctattttgcgatgtcgatattctcacctttaagtccgcacacagcgccttcgattcctgcttcttcatgtgcaatcagccatttgttctttgcggtaagaagcttgtcatcaaatgatttggtatggcaagtcatcagatctgtattggttccctttggaagaactactactgccttaaatccatttccatctactccgcaaggtgcatagtgaagggttgttccgtacacttcgattccaattcctgctgggacaaggaatgcttctacttttgatgtgtcatatgtaaaatccggttcgatatcctgctctgcccccagaagcagaatgatatctgtcactgcgacattcacttctgaacttctgtgatattccagtgcgttcagtttgctgctatggccgttgcagtatccgatctggatcggaagttctccgtaaactctcatcttcagatcgattgcaacatccgttgtttccagttcttcaatagatggttcgtagatgacatcctccggaagaggggtgtgttccattgccttgatcagctttgaaaaatcatatccatcgatcacacgtccgtatctgctgaattctggatctgttacttttttgattttcatttcttccaccttctttctgtcttatattctaacaggctaagtcggtatccgctaccgaaaacttagcctgttaactgcactttcttgtccttatgctattttttattatttagaacgtttcttagattctacatcaaagataacggctgcaagaagaacaataccttttacaactttctgccagttggcatctacacccatgatagacataccgaggttgataacacccatcaaagttgcacctatgataactccagggattgtaccacttccaccgtaagcggaagcgccaccgatgaagcaggatccaatggcatccatttcgtatccatcaccggctgtcgggtttgctgagttcagacgggcgataactgccattgctgcaactgctgcaagaagtcccatgtttgcataagcgataaagtacactttattagtattgataccagaaagctgtgctgctttctcatttccaccgattgcgtataaatgacgtcctacggttgtctttgatgtcagatatccgtagatcagaacgatcaatgctacccagattaagatcatcggaatacctttgtactgtgccagtctccacataaatgcgatgattacaatactgatcactgcgcatttaacaatatcattaaccgctggtccgactttatatccttttttgatctttgacattcttcctttgaaagtcataagtacaaaaactgctgcaatgatgattcctgcaaggatacaggtaatattgattccgtttccgtggaacacatctacaatgtaattgttaaacagtgccaggtatgcatccggcattggagcaatcgtaaaaccattcagaatgatattagaaagaccacggaagatcagcataccagccagtgttacgataaatggtgggatacgtctgtaagcgatccagaatccctgccatgcaccgattgcaagaccggtaacaagcatgataagaatagataccccaacactcatgcctttattaaccataaatgttgcacctacagcgccggcgaaacatacaactgaaccaacactcaggtcgatattaccaccagttaagatacacagtaacatacctgttgccaggataaatacgtaagagttctgtgaaatcaggttatttacattctgtgggagaagcattcttccacctgttttccatgtgaaaaacagtgttacaatgaccagtacaatgaccattgtatatttctttaaaaaagcagatacattttctttactcataactattctcctttgcttgaactcaaaattcgtcccatgatgacttcctgggatgcctctgctgcatccagttctccgacgatacgtccctcattcataacgtaaatcctgtcagacattccaagtacctcaggtaactcggaagaaatcatgataaccgattttcctgctgccaccagatcattgataatacagtaaatttcatattttgcaccaacatcgatacctctggttggctcatccagaatcaggacatccggtccggcgaacatccattttgcaaggagaaccttctgctggttaccaccacttaagtttcctacattctgttctacagacggacactttgtacgcatcttctgtctatattcctctgcaaccgcaatctctttgtcacggtcgatcacaccatgggcactgactccgtcaaggtttgccagagttgtatttacacggattggattgctcagtattaatccgtttccttttctgtcttctgtcacatatgcaattttgtgttcaattgcttctttaacggtatgaagtttcacctctttaccattaatatataattcaccagaaatattttttccatagctgcgtccgaaaatactcattgcaagctctgtacgtccggctcccataagtcctgaaataccaagtacttctcctttacggacatacatagacacgttatctaccactttgcggtcagaatatacctgatgatgaacggtccagttcttaacctccagtgctttatcgccaatttttacatttttcctcttcgggaaacggtccgtaagttcacgaccaaccattcctttgataattctgtcttccgtaatttcatctgttctcttatccatcgtctcgatggtacttccatcacggataactgtgattttgtcggctacataagcaacctcattcagtttatgtgtgatgatgatcatcgtcattccctgttttttgaactcaagcatcagatccagcagggcctttgaatccgattcattcagtgatgaggtcggctcatcaagaatcagtaattttgcatgttttgcaagtgcttttgcaatttcaacaagctgctgcttgccgacaccgatatctttgatcagtgtacgtgatgactcatgaagtcctactttcgcaagatattcatctgcttctccataagttttactccagtcaattgagaatttctttccctgttcattaccgagatacatattctcgccaatcgtcatttccggaaccagtgccagttcctggtgaataattacgatacctttttcttcactgtctttaattttattaaatttacagacctcgccatcgtaaataatatctccctcataagtaccatatgtatatacaccactgagtacattcataagtgttgactttcccgctccgttttcacctacaagggcgtgaatctcaccttcttcaactttaaggtttacattgtccagcgctttaacgcccgggaaagttttggtaatatttttcatttccaataaaaccttacccaacctgaatccctccttctcttttagcggcacaagcgggattaaaatcccgcctgtactcatttaaatatgtatcgtattacttaatatctgcttctgtataatatccagaatcaagaagcatttcttcgtaattgtcaattgtaacaactgttggttcgcaaaggtaagaaggaatgatgcctgttccgttatcatatgactcattatcatttgtctcagcttctttgccatccatgatcgcatctaccatcttaactgtctgttcagcaagtttacgtgtatctttgaatactgacatagactgttttccatttacgatgttcttaacatttggtttgtcacaatcctgacctgtgatgaccggccattttcctgtgtagtttgcttccagagcattttcaacaccaagtgctgtagagtcatttgagcaaagaactacgtcaaggtcttttccgttatagttggatgcaagaattgcttccattcttgactgggctttttctgtagaccagtctgctgtagcaacttcttctttcttaacctgtcctgactggacaaccagttttcctgaatcaatgtatggctgaagaacttccattgctccaccgtagaagaagtttacattgttgtctcctggatcacctgtgaagatttccagattgtaaggaccatctgtattatcaaggtctaatgcatccacgatgtattcgccctgtttctgacctaccaggtagttatcaaatgttgcgtaatatgtaactgcagatgagttcatgatcagacggtcataagagataaccgggattccctgttcttctgcctgttttaacggagttccaagtgattcaccatcaatggatccgattacgattgcgtcacatcctccagataccatgttctcaacctgtgaaacctgtgtagcaacatcattgcttgcaaactgaaggtcaacttcgtatccggcatcctccagctgtttcttcatgttctcgccgtcctgattccatctctgtaagtcttttgtcggcattgcaacaccaatcttacctgttccggcttttgtctctttcttatctgatgagccagatgatgatgaagtatcatttccgcttgtacatgctgccatggataatgtcatagctgcaatgacgcccactgtaagaagctttcttgttctgtttcccataattcgtttcctcctttaagaaaatttgtttttcttgatgcttatactatagcagttcacaaactggacaagattgtaaaaaaccgtacatatttatgatattattgtgtaaaaaaagaaaggtagcacaaatttgtactgcctttctgtcaaaaatgtcctagtcccggctctcttccgaaacattcagatatacttcatcatgtaaatggaatccaagatcaatgatcactgaatccatattttcttttgtcactgcaatcggcggaagtccccaataaggaacatctttcccatcatccgttgtttttacactgttttctccaatatcttttccgacaatctgttctccgtttgccagttttaccgcacactttgccgccacttttgcaagccgttcaatcggtttatacacagtcatcgcttgtgtaccttccacgattctctgacaggcttccagatcggcatcctgcccggtcacaaccactttcccggccatctgcttttcactgagtgctttgatcacatacccggcgatcgcatcattgccgcacataacaccatctacttcctccagctcagccagtgcctcattgactgcctgaaaaccggtctccggtttccacgaactaacgcttgtcttcttcacaacattcagattactgtccttgatcatcttttcaaatccttttgccacatcctgtgaattggcatccgattctggtccgcagatcataacaatattgcctccatccgggagtttctccagcatggtctttcccatctcttccccaacactctcattatcaactgtgatatagagatctgtttttgttccctggatcagacggtcataggaaattacccggattccctctgattttgctttatccacctcttccgtcagtccataagaatccactgcaacgatcacgattacgtccatcttctgtgcaataaaatcctcaatctgctttttttgcttttccagattattattcgcattctgcacatctacctgcgctcccagttcctgtgctactgcggtaaatacatcccggtctctggtccacctttccagaaccagagtatcgatcgtaaatccaatcttcagttgctttttatcacttctatcggtctttacgccctgcgattttgctgaacatcccacaagtagctgtcctgcaaaagcaatacacaccaaaaataccatccatcgtcttataggtttattcatatcgtccctcctcacggtattccgtcggtgtcacacctgtccattttttaaaaatacgactgaaataattgggatctccgtacccggattccatacagatctctttgatactcttctccgtttccataagctgctttttcgcatattcgatccgcagattgttcacataatctatgtaattgacattctctgattctttaaacagcttacttaaatagtaggaactgattccaagttcttttgccgtctcttccagagaaatttcccctgaaaaatgctctgctatataaacttttgctttttctactacattaaccgtcttctcctgttgtttcattgagatgtgtcctgctgcttctgtcattttatgcacaaaccatcgttccagcccttcatatgtctgaaagctcatcaactgatccagataatttgcccttacatcaaaatgataagtcattgccccctgctcgtagacagatttttcagcaagcaggacaaattccattactttcaggcgtacattgttcgtaacctccggaaactgcttctccatccacatcacaaactctgtacttcttttttctgtcagttctgcatcccctgcgtgaactgcatcaaaaagaccggattccatatcatacggatatccctcttcatatacacagctgactggaagatcctttgcatggttcacctttcctactccctgccttgccgtatcgagtgcttctctgtaggacttggaaacttcctcccaggatacgacagacccgatgcccgctttgaatttcatttccatctgctgctccattttacgaagcatactgcggatattttcaatctttacttcccgctcattataagattcttccttttccctgcacgggacaaggacgattactttgtttcccatcagagatcctacaattccattcatcgtctccttaagcatttcacggaaaatcatgctgtgcttttgcagccggattcctgcacctactgtgttggtcagttctccttttcgcaattcttctccgcattcgatcactattgcatagacatactccgtattgattccaagcagctcacggtatgtaagattggaggtatcattgctctctccaagaagaacgctgtacacaaaaccactttcgatcatcggaaccacaacctcaagtttttctttcaccttcagatccttatttactttttcccttctgtcatttacaagcttcatcgcctttcgcagagtatccgtcagcacgtccttattgatcggctttgtcagataagacataacgccgatatcaatagccttctgtgaatattcaaatttatcataggccgtaagaacaatgaaaatgatatttttatgttctcttttaatctcttccattgcttcgattccgttgatccccggcatctggatatccatcaggataatatccgggcgaaatgactctgcaagttcgatcgccatacgcccattttttgcagattcaatttcaaattcatctccaaagcttttctggatcataaatctaattgcctgctgtacaattccttcatcatcacagatcaatatcctcatcttatgtcctcccttttcaaatagatcaacacttctgttcctctctcttcccgccgacggatctcaatcacatgctccatattataataccgtttcagacggttgatcacattatccataccgattccggcggaatcccgctgactgtggctgtgtgcactctctccacgcatgatcttttcgatcacttccggttcaattcccacaccattgtcttctactttcacgcagaccataccatcatcactgtaaacagacagatggatctttccttctccctgcagttcgcgtattccatgatttaccgcgttttcgatcaggggctgcaggatcatacttggcatcattgtaccagtcacgcgctcatcgatctgttttgtataatggatttctcctgcaaatcgtacattcaaaatataaatgtagttgtctaccagttccagctcttccttaagcgtagtatctttctccatcttccttacattatagcgaaagaaatccgccatgttctgtacaaacaaacaggtattttctgcaccctccatcatggcaagctgtgctgctgcattcagactgttaaacagaaaatgcgggttgatctgcgcctgcagatatttaagctgtgcttccttaaggtcatttttcataatcagttcattctcgatcagcctgctttcccgctcatagttctcttttgtctgcctgatataatcacggatactgttcatcattttgttgcaggctttcgccaccgtactgatctcatctccggtatcaatgatcggaaaatctacctccagtccacctttggcgatcgtatttgccgcctccgcaagtttaataagcggtcttgtaatcgttctggtcatcataacgatccatgcgagtgctacaagcatggatacggtcagaagaaacatactgaatccgacaacgtaattcagtgtggatctcaaaactgaataattctgcgagttttcaagaaacaccgacgtattcaggcttcggacacaggactgcagataatcataaagcttcttcgccttactgtattcttcgttataacagcttacatttcttccccgctttgcctcgatcgcaccggctgttttttccagatatgtatccgacatattgcggatatttttttccatcagaagattctggtcatttaccgtctcttcattcagttcactgatcagatttctataatcctgctcatataaataataattttccagttcatccgaactttttgtattcagatactgataaagcgatgtctgcattttctccagcgttgtcgagatatcatttaactgaatattcgaattatataccccgtcaatctgccggatcgcctggctctgactatgcactatatacatgttgatcgcaaataccagtaacatgatcactacatagacttccagcagccggatccggattgattttctttttttcatgtctttttactactttctattctgtatactttttaatattatcagcagtgataagctccggggatactgtcagatattcgctgatatgccgtttctttaaatactcattcattccctgttctgcagtttttccccactcggtcggattgatcaggacactggattcgacgattcctttctggatcccctccagtgtatccttctgcgcataatatccgataatcgatgtctgtccaaccttattgtaatcaaccacacactggatcgcactgctggtatccaccgcactcatacatacgataatatccggataagaagtatccagaatcaggtcgcggacattctcttccgattcaaacatccctgtattatcgatcaccttactggtcagctcgatcttggatgcaatagaagctgtcgtctctgatattgccgtaaaaataacattcggcgctgcattcctctcttctgaattcagaagaacagtgacccggatcttccggtcttcctcttctgccttcttctgtgcaatattattgatctggtttccatacatttcaccaatcgcataatcatttccgcttacaaatgatacccttttactggccggcgcatcactgcggatcgtgatcaccggaatattctgttcttctgccttgtcaatctgtgcggaaaccgcttcttcatcgctcacctgtacaataatcccatctaccttggccgcaattgccatttccatcaattcttctgtcgaatattcacccgacagtgtctcaccaaaattctcgatcaggatctggtctcctttcccggcatctttggctccctggtatatcttcttccagaagctgtctgtgggattttcactgataatcgcaacatgatactgataatccgtccggtcctttttttccactctggcatctttttttactttttcatgatatatcatcccaataccgatcaggaccagaagtgcggcaagagccacaactcctatccctatcagtttcttccagttttctttataacttttcatcttccgattcctgctttctcattttacggaaatcacttggtcttactccatattttttccggaatgctttggcaaatgctcttccgtccgcaaatccactatgttctgcaatttcctcaaccatcgtatcactgcttatcagttcccggtaggcatattccagacggattccctgaatatattctttatagttgatttctgcatatttgcgaaacatccgtgaaagataggtcggcgaatacccgaaaacctgtgccagcccttccagcgagagatctttctgataattatccttgatataattcgtgatcgtagaaagtcggttcctgttcttgtgatcccgcacgatctccgcactgacatcaaccttcctgtattttgtcaccatcagatagaccagcatataaaaataactctgtacctttaattcataccctgttttcttcttctgatacgtcacatacatcttttcaaccagttcaaccagttgttcatcctgtacgcgttcgctgtgggtaaaacagataaactgctcatccgtataataccgttcaaatgtctgaagtggcatctgcagtacgatcgtcttattcggaaacggtgccgaaatcgaatgcagctcattagaattcacgatcacaaatgatttttcatctaaatggatatcttcttcattgatataaaaatccagctttccttccagtacaacaaacatctcgatcgaccggtgccagtgcttttccctgacataatttccgtcttttccttcaaataaaaacatccggaatggcagatcttcattcggcagaaccagttcatgtgaaaattccatctaattcatccccttctctgtacattctctgagcagtttcatagcatcctcatacttttcagcagaaacacctgcacaggtgagtaacatcctgttcttctccacttcaagaaatgtcattcctttcttttttgctttttctgcaatcttttctgcagcgcagtcctccgcaaaggtcaactgtaccataaatcctgcagcaccaacctgtacatccacatcttttcctaaaatcttttttgcactgtccgcaagcttttctgcctttgccagatggatcttcctggatttacggacctgactcgccagatgtccgtcacggataaactgtgtcagtgcgatctgctcggccttggatgcagtctgattgtaattattttttcttttttcgtaagtttccatcagttccggcggcagtatcatataactaatcctgatagacggaagcagcattttggaaaatgttcccagataaatgacatttcttcctcccgaaagtccctgcagagacggaaccggtttctgaaaatatttgaactcactgttatagtcatcttcaatgatcagaaaatgctctttctcagcgcgtccgaccagttccagtctttcctggatcggcatcaccccaccaaatcttgtcatctgtgatggtgacacgtaatacattccaatctcttcttccgcacttcctgcaatccggtagttatgatcttcaaaaaccgtcattccctgtacaaactcactgtccctgaaaaatacggttctctttttatgattcagtgggcacagaatatgcagaagactctgtataccggcaccgatcacgatctgatccgggctgcagatcacacttctggtcttctgaatatattcagacagtacttccctgaattcctgttccccctgcggttctccataagaaagcagtctctcatcctgacgcattgcgctcttcatatatctccgccataattcaaaccggaaactctctttatctacatttgatgttgcaaaatcatagacaaccggattctcctgcttccttacatgccggcttgcaatctttctgccctcttcctgcttctcggcaatatccgtcacataatatccactctgcggtctggacacaatataaccttctgctgccagaagcatatacgcattctccatcgtcgtccggctcatctgcagctcgcttgcacctttacggatcgatggaagctttgtctctgacttcatctgcccggatagaatcagattcctgtaataatgatacactctcagataccggcagtgttcctcattctgtaattccactctcataactgacctctaaaaaatatttctttttgtatattttacaaatgacacttttattttattctatataaaacacataagaaatgcaagaatttttcactttgtatttcggaaaggatacttcaatgataaaacgagtcgctgttatcaatgatctgtccggtcttggtaaatgctctctgacagctgcgatcccggttctttccgtcatgggtgcgcaggcctgtcctctgccaacggcagttttaaccaatcagaccggctacgacagctattactgtacggactttaccgacaagattgatcattacacagaagaatggcaaaaacgtggtcttaccctggatgcgatcagtaccggatatctcggcagcgcagatcaggcggaaaaaatcctgaatttctgtgagaagttcagaaccccttccactctgctctttgtcgatccggtcatgggagattccggtgtcaaatatgacattttcactcccagactccaacagcagatgcagaagcttgtatcccatgccgatgtgatcacgccaaatcttaccgagctgtgtcttttaacacactctgattttgcggggcttaccaagtataaggacgaaccggattatctggaccggattgcccggattgccgctcctttgaaagaaacgaaagaaacgcagatccagacgatcatcgtcaccggtattctttatcaggctccttctgatgataccgtaaaatattacaatctggttctcgagaacgaccagataagcgtcatttcctctggaattcacggaggaagctattctggcaccggtgacctgctctccgctgtcgtatgtgcctcgatggtacagggaaaaagtgcagctgcaggcgtggaaaaagcatgccggtttatcgaaagatctctgattgacaccgttgccgaccagattccgcgcaatgatggaatcaattttgaatcccatctttctatgctgcttgactgacatttacaaaataaataaaacccagggaggtaactatcatgtcatctacaaccattaacaatccagaaccatctgcaaatgcactttctcatcagaaagtctccagactgacttcaacagctctttttgcagcactgatctgtgtgacaactgcttatattttccatattccatttggtgtaaatggcggatatgtacacatcggagattctctgatctatcttgccgctgcatttctcccaacaccatatgccatgtttgctggtgcaatcggtggtgccatggcagatatcctgactgccccggtatatgcacctgcaaccttcatcatcaagatgctgatctcccttccgatcacatgtaaaaaggacaagatcgtgaatgtacacaactgtgtcggcgttattgttgccgctgtaatttcctttattggatattatatcacagatgtaatcctgttcggaacctggggtgcactgattccttcgattgtaggaacccttgcccagtcaggcggaagtgctgtgatctttatcattcttggttccactcttgacaaagccggtttcaagaatacaatgaaaaacaaatttggaatttagccaaatatttaatcatacgcaaatgacaggtggttcttgaatatccgcctgactttcaaagaggagattttattataatgtcagatattatttacacatttaaaaacaatgcatattttaacatcaccaaccgctgcacttgcaaatgtattttctgcatccgtaacgaacatgaagccatcggagaggcaacagaactttggcacgaccacaatccttctttcgaagagatcaaggtagctattgatgcttttgattttacaaattatccggaagccgtcttctgcggctacggggaaccgacctgtgcctacgataatctgattgctgctgcaaaatacatgaaagaaaaacatccggaagttctccttcgcgtcaataccaacggacttggcgaactcttcaataaaaagccgatcgcagaagaaatggcaaaatatatcgatgccgtatcgatcagcctgaatgcgccaactgccgaacgttaccaggaagttacacagccttgttttgaaaatgcgttcccagatatgcttgcatttgccgagaaagcgaagaaactgttctcatctgtgcagttcagtgtggtaagcatcatttcacaggaagaaatcgatgcgtcccagaaactcgcagacgagatggggattccgttgaaagttcgaatttattcgtaagttcattctcttttctactataattaacaaagggacggctgccatactttgcgctgtgctggcagaaaggccaaaagaaaccggactaattccattatgcaaaccattccgatgagcctcttaaggcgaaaatcgtgttcagcaaaggcttccacgatttttgagtctcatctccattgcataataagtgaattaatccggtttcttttggtccttctgcccttctagtgtattcccgtcagcctgatttttgaatgcttgtagcaaagcgaatgaacaggaacttattcattccgattgttattctccctttcaactctggttcgatgtttaacgaaaataatacatgttttccaataaatgcccgatagtcaaatgttttcaattaaacaacagactcctcatcccttctcaaagttttctcctgcttcgttctgaattgctgttatcttaccaatatcaccacattttattcgataaagttcaaagagcgccagccacaaaaggaatcgttcggattctattttgcgctatggagatgagactcaggaagcatggaagcctttgctgaacatgcttcccgtcctaagaggctcatcggaatggttagcgcaacttgaatccgaacgattccttttgtggctggcgctcactcaacctctatcatttgccaaacaaaaatgaccatatactttcgtatacagccattctgtgttctctcaaagagaaagctttcactttttatccaaagattcctccgatcacaacgtaagacaggatatacatgatcaccgatgccatgcatacgccgactacgattgctccgaaagcttttttccagtcgatgccaaggagggatgcgacaagagctccggtccaggctccggttcccggaagcggaattcctacgaagagtaccagcccccagaattcatatctgctgatccgatcacttttgctcatcgcttttttctccagcttttctacaagcggacggaaaaggcgcgtcttgcgcagccatgcaaaaatcggacggatcagaagcaggataaacggaattgggatcaggttccccaccagacagatcgggattgcacgccaggtcgggatatttaaaaacgccggacctgccgcaaggattcctcccctgagctccagaatcggaatcattgaaataataaagataatcagttctttggcagccttgccacccagatgagttacaaaccactgtactaaagtttcagtcatacaaatctcctattttttacttattaaatcggtgcttgacgtgtcaatacgcataaattgcttatttgtgtaagcacaaacgcaatttatgtttttaacacttcatcatatattcacggaggaaggcaaagagtgcttccatctcttctctcgtaccgatcgtcacacgcagatattgctcaatccgctcacttccccagaaacgcacatagattccttttgctttcattgcttcaaagagttcttttgcatcgtattccggatgtgatacaaagatgaagtttgcgcttggttttggaaatacaaagccgagctttttgaattcttcttctgcccagtctcttgtctccacaattttacgtgttgtctcagcaaaatattctttatcttttaccgcttctgctccgtataccagagaagttttgttcatagtataagaattgaacgaatattttgcatcgtttaaatacttgatcaggagcggacttgcgattgcatatccaatacgcattcctgccatcgatcttgcctttgaaaatgtctgcgtaatgatcaggttgtcatatttgtccagaagcgaaagtgctgactctcctgcgaaatcaatatatgcctcatccacaatcacaataacatcctggttgtgtctgatgatatcttccacaaattccagatcttcatagatggatgtcggtgcatttggattcgggaaaatcacaccaccattttccggataataatcttcttttatgatatggaagttttcatctaccttcttgcattcgtatggaatccggtaaagatccgcccatactttgtagaaggaatatgtaatatccggaaagaaaaccggtttttccgagttaaagaaggtaaggaaacacatagagagaacatcgtcagatcccactcccacaaaaacctgatcttttccaacatgataaaagtccgccagtgcactgaccagtgtatcagatgtcggatccggatacagccttaaactgtccacatgaccctccagctttttcattgccgcaagaactcccggtgcaggtgggtacggattctcattggtattcagtttgatcacttttttctgtggctgttcacccggaacataaggttctacttttcggatatttttctcaaattctctcatcttgctttctcacctttctgtcacatcttttgcttttgtcttatcctagctgatattcttttgcaagctctttgaatttcggcagtgcatttacgattgtctcataagctacacaatatgcaattctgacatatcctgcacatccaaaagaacttcccggtactagaagcagattatatttttttgcttcctggcaaaatgtcttttcatccttgatcggagtcttcatgaacaggtaaaatgcaccctgcggtttgacacattcaaatccacattctatgagtccctggtaaagagtctccctgtttctattatagtatgaaatatcggttttctcatgcagacatcttgcaactaccttctgctgcagggttggcgcattgacaaatccaagaatacggtttgcaacatttgctgctgcaatgagtgtctctgaatcttttacatcatccggaatcaccagatatccgattcgctctcccggcagggaaagagatttactataagaatatcctacgatcgtattggcataatacctggtcagatacggtacatccacaccatcataagcaagttcacggtatggctcatcagagataagataaatctctgttccgtattcgttctgcttcttctccatgatctctgccatcttcctgatcgtctcttcggaatagacaacaccggtcggattattcggtgtattaacgatcactgcttttgtcttcggtgtgatctttgcctcaaattcatccagctttggctgaaaatctacggtattcggtgagatttcaaccagaacaccgtcaaaattattgacataacttctgtactctccaaagtacggtgcaaatgtgatcacttcatctcccggatttaacagtgcttttaaaataacattcagtccgcctgctgcgccaactgtcatcgtaatattttttgctgcaaatgcagtaccaaatcgctcattcagagattcagctacagcctggcgaacatcttcatatcccgcattgctgttagtatatccatgaagcaccagttcatcttcttcatccaaaatatcaagaatcgcctgctttacggctttcggtgccggtacatttggattaccgagactgaaatcaaatacattttccggtccgtaaatttttgcaagacgatttccctcttcaaacatggcgcggattgccgaactgtttgccaccatattttccatcttcttagatatcatcttttgcacactccttttcgctgtcttcgtttaatgtcacaacacctttttctaccataaataccggtttgtaggaaagcttggcctttcttaatccttcttctccaacatcatcttcccggttggtatatttgtattttccggcaatttcatgctctacgaactgctggttgatcatggtatacgcaccttcaatatccgcataagctttttcgatatgaaccacaaaggtatcgtcatttaccgcttctccaatcgtaaatgcaacaatctcatcaccaactctgagcagacctccgatcaggttcagttctttgtaaaggcgcagtgaattgagtgttacacacatctcggaattcttctcttcatcatcttcacagccattcagattccgccatttcagtgccatctgaaaacactcttccagattatcctctgtaatcgtttcataactccagttatctccgtgaagtgctttaaatttattgacgtgattccgcttgccgtgcagctttttgccggaaagtgttgcaagtttctcactttcatagacataatccgcctcatctctgtgataggtgatgtcgaatttgcctggaaaccatgtttcaagcttggcgaaattctcttttgtcaccccatacagacagaatggaacgcctttttctttctcccacttcatgatatcttcaatcgctgctcttacatcttcatcttcacctgccggaaatgcatagccgtaacctgcactgttatcccggaacaggagaacgttattatattgtgcaaattctacttcgtaaaaccttgcccacagatatacatttgcaaaagtacggtcgcagcttctgcttgggtactttttgaaataaaaatcaataagatcccggtctgtcagttctggtcttttaaattttgcttctgccataaaaaatccttccatattccgcttttttgcggtactgtctgttagtataccacattttgagtggatttttgcggttttcttgtatttttttgtgttacttgtaaagttagtgggccagttgctccactactgttttctgaaataaaaactatttcagtctatagatgaatacaggaagtggaggatcatttttacggttaaaataggaatttacgattacgagccattttttggagtctaatgttttgagataattcaaaatggcttctttttcttcgtagccggtgtcaccgccgctgtagatgcagaggtttatgatgccgccttttttgagcaggttaagggctgactcgatggcggtgaggctggtggctgcgcgggttgcgattttgtggtcgccgccggggaggtagccgaaattgaagacgatgaccttagcttcttcttttacataggtctgcattttttcgtgaccgtcctggatcagcttggctcttgtcgacaggttcgctttttcgagacgttctctggtatgagcaatcgccatctcttgcacatcaaaagcatagacatttccggtctctccgactttctggcacaaaaactccgtgtcaccgccgtttccggcggtggcatcaatgcagatatccccttcttctatatactcttctaaaatgtgatggcaatattctgtgatctgaaaattcatgtcctaaacctcctgcttatgttcggaaagtgcgcattgcctcgatgatctgtgcgatcagagctttcttcttttgttatcattttctgtcacttatctgtcttttatttaccgggcaatccatttggaattttctgtcgaataaaaattaagcatttcccgtacttctttttcgttatcgaatgggttcctgataatcttatactctttaccttcccatgggattgtgatcttaccattttttaccgtcatctgctcgatggctgtccgtggcagctgtacgagttcattgccatccttgtcatagaatgccataccattgtcccagtaaatgatcacacgcatcattttcattccatagctgcgcgtaaccaggcacaccactgcgatcacaaggaaccagatactgtaggtcagcccgccggcaatcccgcttcctattgcgcacagaatgcagaaaactgcaaatggaagcatcagatatttaacggtcatgccactgtaatacccggataccagacaatgaaaactgcccttccattcatttccaaatttcgcagcttcctgctgtgtcttattctggatcacctgattcaccgcctgcatgatggcattccgaaccagacgctgtacaatatgtcccatcttttgtacctcctcatgttctctcatttatgtcaattttagcatatcctgttactttttcaaccacgcagcgttatatatgatataagtttttcttatatcactattcatagaatgtatttcccattttctcccatttctcctaaattaaaagtatcgacttatggaggtactgaccaatgaaacttactacaaaaagaaaagaacagatttcttctgttctcatcatctgcctgggaaatatactcaacgctttttcagccagagtctttcttcttccggctgaccttgttgccggtggcacgaccggaatcgggctgattctgcagcgcataaccgggatccctctttcctctctggtgctcgctttcaacattatcatgctggtgcttgcctatattttcctcgggaaaaaatatacattatctgcaattttaagctcttttatgtatccgatcgcactggaattcttcaatcagatccttggagattatgttctgacagacaatctgatcctatgcacactctttgccggcatcggaatcgggatctcccttggaatgatcatccgtaccggtgcttctaccggtggcgtagacgttccgccactgatcttaaataaatatttccgttttcctgtttcagccggattgtacatcattgacttctttgtcatcctggggcaggcactttatcagccagttgacaaggtactatatgcgattttgtatgtgatcatttacacccttgtcatgaacaagctgatcgtcagtggaacttcaaggattgctgttcagatcatcagcaaacattcagatgaaatccgtaattttgtacttacccagattgaccgcggtgcaaccatcattccagttcagggtggctatctgaaccagcagctgaatatggtactcaccgtcatctccaaccgtgaactcgtccaacttgaaaaaaatgttcatcagatcgatccggaaagctttatcatcgtttcccaggtacaggaagttcagggacgcggatttaatctggataaacactggaaaccagagtagtcagatacctctgaaattcccggatttccggctcttttttctttgatttcaggcaggcaaaataaagactgtcctgcctggctggaaccagtggcaccgccgtaaccccatagtattctgcaaaggactttggtccgatcgcgattccgcttccgcttttcaccatcttcatcaccgtgtcgatgctgtctgagcggatgactcttttccatgtgatattctgttcaccatatgtctttctgaggagacggtcttccaccgaatgctccagtcctgtgagcatagtatattccctgcaatccatgattgaagcatttttcttctgcgcgagcggatgatccggtgccatcagtatacactgcttctcacggatcagttcttttgcaaaacagacacatttctccatgccgatttcattttccggcatccggtccagtgccatatcaagggaaccgtccttgatcgccgcatatgcatccagcccagcctccgtataaaatgtcacctcaagctccggatgcctttcaaaatatctggcaatcttcggaaacagtctgttggaatagactctggcaccaagtccgatttttaattttttatgttctgttcccgaaatcacttcttctttaaaacgattccagtcttttagcatttcttgcgctttttggtaaaaaacattccctttttcggtaagttccagtcctttgcttgtcctgtgaaatacgcggtatcccagttccttttccagattccggatctgctgggacagagcgggctgcgagacgaaaaggtactctgctgcgcgggaaatgcttttgcaatttgcgatttctacaatgtaagttaattgttgtatgttcattcaacgcctctgttttgtttttcggtatataaaaatcccccatacgggacatttctattttcttgacctgtatgagggtatcctattactattttttagcaggagtgcgtcctgcaagccatcctctgacggtttcaatatttgcttttattgtccgatcaatatgggcgatcgggcatgttcttgaaatccatctgcacttcgttgtcaataactgtgagttcttcatcatccataataattcgaagaacatactcacaggctttcctgtctttatacacttttgcctgcttctattatactgcctcattcatcgatgccagctttgctgcctggtctgctgcgatcaggctgtcaatgacttcatccagatctccgttcataatgctgtccagcttatgaagcgtaagcttgattctgtgatcggtcacacgtccctgtgggaagttgtaagtacggatcttctcagaacggtctccggtaccgatctggcttcttcttgcctcagcctctgcagaatgctgcttctccagttccagttcatataatttggaacgcagaagacgaaatgccttttccttgttctgcagctgtgatttttcagtctgactgtagatcacgattcctgtcggataatgagtcagtcgtacagcagagtctgtggtattgacacactggccaccgttaccagatgcacgcataacatcgatacggatatctttttcatcgatcacaacgtcaacttcttctgcttccggcatcactgctacggtaatggttgaagtatggatacgtccgccgctttctgtctctggcacacgctgtacacgatgtacaccactttcatacttcatacgggaatatgctccctgtcctgtgatcataaatacaacttccttgaatccaccgattccgttttcattgagggagatcatctctgtcttccagcgtctgctgtctgcataatgtacatacatacggtagatctcagccgcaaaaagggcagcttcatctccacctgcacctgcacggatctccacgataacgttcttgtcatcgttcgggtcttttggaagaagaaggatcttgagctcctgttccagctcttcgactctcttcttagactcactgagttcttcttttgccagctctttcatctcttcatcggattcttcctccagaagagaaagactgtcttcaatgttctgtttacaatttttatattctttatatgcctcaacaatcggggtcagatcattctgttctttcatcagcttgcggaaacgtgactggtcattcaccacgtccggttcctgaagctcacccataatctcctcataacgaatgagcagatcttctaatttatcaaacatttcttttcctcctgttatttgctacgcctattgtacacgccacataccacacggtcaagacctgccagatccttttgcgttgaaacctgttcaaatccagtctctttcagcaatttttccacatctgcactctggtcatatccaatctccatcacaagccagccgccgtctgtcagatattccggaatcttttctgccaggatccggtaaaaataaagaccgtcctcttttccgtccaatgcctcatacgggtcatgaagacgtacctctgcttccagctcttcgatcacttttgtcgggatataaggtggattcgatgtgatcatgtcaaatgttcctgtaatattttcaaacatatcagtctggatccacttaccgctcactcccagctttttggcatttttttcagccactttcagagcttcttctgaaatatctgcaccttctatgacaatctgcggatttctcagtttcaggctgattgggatacagcctgaaccagtacacatatccagcacttttaccggattttcctttttcataagaagcagtcttttttctgcttcctctacaagaatctcagtatcctgtcttggcacaagtacatgttcattgactgcaaattcatatcccataaattcctgaaccccggtcagatgctgcaccggaatccgggtttttctgcagcttaccagctcaaagaaccggtcttcttcatttttcggcattctttcaaaaccatccacataatatctggtccttgtcatgccggtcacatgctccagcaggatccaggcatcactttccggctccggaatccccgccgctttcaattcacctgtagctttctgatatgcttcctgataggtcacagcttttactcctcttccttatatccgaaattctctctcaaatacgctttccagtcaaacaccgcttctacagacgcaatcccgacctcgatcatctcatcgtccggttcctttgtcgtaagcccctgcagccaaagtcccggcttacttaagatacacacgatcggattctcactgcttcctgcccatttgatcaactcataagaaataccagcaatcaccggaagaagtgcaattctcacaatcactctcatcagcggagattctacccttacaaaaaataagagaacgattcccacgatcatgacaaacagcatgaagctggttccgcatcttttgtgttctttagagctctttctaacattttcaacagtcagtggaagtccatgttcaatacagttgatacacttatgctccgcgccatgatagcgatacagacgcttaatatcgttcattaccgaaatcccgcccacataggcaacaaaaatcgcaatgcggatgattccctcaatgataatccgaactgtataggaagaaatccatttcttcagcagatctgacaaaaaatacggaagtaccataaaaataccaatcgcaagtgcaaaagatacaaccatcgtcagcgtcatcaaaagcttttccatacgctcctgcttcttttcttcggcttcggtcatctctttttcttcctcttcctcatagaagcttgctgaccaggtcaaagtcttcatccccagcaccagagaatcaacaaaattaaagattcctctgacaaaagggagcttcgtaagtgccgtatattttccaactacacttttatatgtatctgttgtaacttctatctctccgtcaggctttctcaccgcaaccgcataacggtctttattcttcatcatcacgccttcgatgacagcctgaccaccaatattcgaagatttcatattctgttatgtcctttttaattcgtcgtatacacaaaataggctgagatttcacaatcccagcctgttgaattctcttattactgaattccgtatttcttgttaaacttgtcaacacgacctctggcctgagttgctttctgctgtcctgtgtagaacggatgacatttagagcagatttctacgtggatttctttgcttgtagaacctgttacgaatgtattcccacagttgcaagttacagttgcctgatagtaatctggatggattccttctttcatgattttcacctcttcttgttttattcgttttacgcgctttcacgcggctaatatctttaaacagctatgttagcataacatagtttttttctaaatgcaagtaattttctaaataaactttgtttttttgaccatttggacaaattctacgttatttttcgtgcggtcaaacatattcagaatgctgtctaccgcttcatctgacttcattccgtttaatgcacggcgcataatatccactgcttcctgctcctctttcgtaagaagcagatcctctcttcttgttccggatttcgggatatcgattgcaggaaagattctcttttcagaaagcttccggtcaagcaccagttccatattaccggttcccttaaattcttcgtagatgacatcatccatcttgcttccggtatctacaagtgcggttgcgaggatagtaaggcttccgccctcacgcatatttctcgctgcgccaaagaaacgtttcggcatatgaagtgctgccggatcaagaccaccggacagggttcgtccgctcggtggaacaaccaggttgtatgctcttgccagacgggtaatgctgtccaaaaggatcacaacgtcctttttgtgctcaaccagacgttttgcacgctcgatcaccatctctgacacacgtttatgatgctccggaagctcatcaaaggtcgaataaataacttccacattatccccttcaatggcttctttgatgtcggttacttcttccggacgttcatcgatcagaaggatcagaagatggatctccggattattcttcctcatagaaagcgccacctgcttcaacagggttgtcttacctgctttcggcggtgatacgatcatgcctcgctgtcccttaccaattggagagatcagatccataacacgcattgcagtgctgctctttcccgcttccagtctgagacgttcatttgggaaaatcggtgtcatattttcaaagttcattctgcgtcctgcttctgccggagacattccattgatcttggtcagatacagaagcgcactgaatttttcagactgtgtctttactcttgtatttcctgtcaggatatcccctgtcttcaggctgaatctgcggatctgcgatggtgatacatatacatcttcctcgcccggcagatagttctgggaacggataaatccgtatccatccatgacttccagaattccattcaccgtacgtccactgtcgagctgttcaatatctgcggttccggctttttcggattttacttcctccttcgcctcttttattgaaactttgtcatcttcttccagcataagatcgatcagatctgcttttttcatcgttgaaattccgcgaagtccgcgcgtttttgccacctcttttaatgtagaaagaggcagggactcatatttttctctcgtcatatgttctatattcctcctttattccaattacttttcttatccaaaaaaatattaaacttttaacattgggaaatcttgtctgaactgactaatctgcttttgataaacccaagtatacaacattttgcacaaaatggaaagaagttttttgatttgctttcatatcagaagaatgttatcataaaagagcagcaaaactgtaatcaaaggaggacgtatgaaaatgtcagcaattgagcaagcacttgaaatgcatgaaaaatggaatggaaaaattgaaactactgcaaagtcacacgtaaactctcgtgaagacctcgcaatcgcatatacaccaggcgttgccgagccatgcaaagtcattgcaaaggacccggatgcagcctacaaatacacgatgaaagccaacacaatcgctgtagtatccgacggtagtgccgttctcggacttggtaacatcggagccaaagccgccatgcctgttatggaaggaaaagcagttcttttcaaagaattcggcggagtcaacgcagttccgatctgcctggacactcaggatacagaagagattattaagacagttgtcaatattgcacctgctttcggcggaatcaacctggaagatatctctgccccacgctgttttgagattgaaagccgtttaaaagaacttcttgatatccctgtattccacgatgaccagcacggaaccgccatcgtcgttctggcaggcatcatcaacgccctgaaagtaaccggcaagaaaaaagaagactgtaaaattgttgtaaatggtgctggaagtgccggagttgcaatcacaaagcttcttctcacctacggtttcccgaagatcaccatgtgtgatatcaatggaatcatctcagctgattcaccgaatctgaactggatgcagaaagagatgaccaaagtgaccaatctcgaccatgagaccggtacacttgctgatgcactcaagggtgctgatattttcgtcggtgtatctgccccgaacattgtttcccaggaaatggttgcttctatgaataaggatgcgatccttttcgcaatggcaaacccggtaccggagatcatgccggatcttgcaaaagctgcaggcgcaaaagttgtcggaaccggacgttctgacttcccaaaccaggtcaacaacgttgtcgctttccctggtatctttaaaggtgcattagagggacgtgcaccacagatcaccgaagagatgaagcttgccacagcaaaagcaatcgctggacttgttccggatgaagagctgaacgaggacaatattcttccggaagcttttgaccctcgcgtatcacaggtcgtaagtgaagctgtcaaagctctgatttaatcttatgaatacaagaacctatgatagcaatcgcccgcaggaaatatcctgcgggcttacttacaaaaaaggaactcctcagcgctggggagaacggcgctactatgcactggactactatctgaaacagaatttcggtgaaaaactgtacaagatttctttaaacggaggctgttcctgtccgaaccgggacggaacctgcggcacacgcggttgtatcttctgtagcgaaggtggatccggcgattttgccgcttcttcttctctttccgttgccgaccagcttacctatggaaaagatcttgtacgccctaaatacaacgggcacaactatatcgcctattttcaggcatataccaatacctatgcaccagcctgtcatctgcgccggatctttaccgaagcgatttctgatccagaagtacgcattttatctatcgcaacgcgtccggattgcctttcacctgaaatccttacactgcttgccgaactaaatgccattaaaccgatctgggtagagcttggacttcagacgatccacgaacgcactgccaactggatgcgccgtggttatccactttccgtctttgagcaggcggtccattcccttcacgcgattggggtacagatcatcacccacgtaattttatttcttccgggagaatctgaagcagatatgctcgcaaccatccattatctgaacgctcttccgattgacggaatcaagctgcagcttctccacgttctgaagcataccgatctggcagatttttacaggcaggaacctttttatattccagatatgaactcttattttcatctgctcggaaaatgtatcgcttcgctccgtccggatattgtcattcaccgtctgaccggtgacggaccaaaatctcttcttatcgcaccgctctggaccggcaataaacggttagtactcaatcagatgcagcgctatttaaaagagcagaatctctggcagggaaaagaatatactacattttaaggaggcagccctatggcagaagcatttacactttataaactcatcattctatacatgctggacaaagttgattttcctctgaccaactcccagatttctgaatttgtcctggacaaaggatataccgattatttcaaactccagcaggctctttctgaacttgcggacggtggtctcatcctgaaagaatccactcacaaccgcactcttttccatctgacggaagatgggaaagagacgattcatcttttccaggataaaatctcaaagccaatccaggatgatattgaccactttttacagacaaaacagtatgatctgaaaaatgaagtttccgtaaaggcggattatatgaaaaatgcaagagaggaatattccgtgcgctgtcaggtctttgaaaatcacgaacccctgatcgatctgaccctttctgtaccgactgaaaaagaagcgacggcaattgcactcaactggcagaaaaaaaatcaagtcgtctatgcgtggctgatgtctcagttattgtgatggatgtgaatgatacggttcgcaaattaaggctgtgattgggcaatgatacacttgaatctcacgatatgaaaactctacgttgttctttgggcagatctcagctacgttcttgaaagcttgcaagcctcatgcctgctccaaaagagctgaatcccgggcacggacagaaaacaaatggataaggattccatgtttgtgctatggagatgagacacaaaaattgtggaagcccttgctgacacaattttcgccttaagtggctcatcagaatggtcagcacaaaggaatctgctctatttgttttctgtccgcgcccggccacaacctacaaaaaaagcagaccgtcccatattccgatctgcctaaataaccaccacaaaactgatgtatttcctttcttctatttccaccgtaatttctccgtggtaacgattcacaagcatctttgcattataaagtcccagtccatgcttttttccatcttctttcgtagaaaatcctttttcaaagaaatgactgatctcgccaagtcctatattttcgacctgattctttatcgtgaagataagcttatcattctgggaatcaatttcgatcagtacctgatttttttcttcggtacaggcttcgtatgcattgtcgatcagggttccaacaatctcgatcaggtggtgttcggaaatgccggaaacgatttctttgttccacacgcggatatcggtccggacatattccggcgcacggacaattttactgtagataaatcctgccaggattttatcgctgatcttcagaagggggagatacttcctgctgtcatcttctctggcaatttccgtaatatattcagactgctttgctaccagttcttcataattgtcgatggtcagatgcatattcaggattgcattcagatgattgtcaaattcatgctgtttggcacggatttctttgaccagttcttccagcggaatcagatagttctgataaagccgcagttcattttccttctggcgtatcagtacataattacttctccagtccacaattccccagatcacaacaatcaccatcagaacaaacatgataaacaccctgtaatcaaaggtaccgctgatcaggaaatccacgatcagatagactgataccataagtgccattacgcagaaaatacgatatagaaatttgcgtacccaatcagtcatttaacagtcctccgatcaccgatttgtaagtcacaccgatttctaccgtatccggacaatttttgatccggatgatccggttgacggtatcgtaatattcaacttcatttttattgaccgcatacatccgatggcactgcgcaaacatcccttttggcatcttaagcagcatctgtctgagagtcacataagggacatcccagttctccgtcacaagatgcagtcttgttcctctcggtatcgcttccagataacggatatcctcgcatttcagctgataattgatcccgccttttttcacaacgatcaccggtggtttctccctgctctctttttccagcaccttctgaacaacctcttccacctgctccctgcgaaatggcttcataatgtactggtaacagtgcagctcccggtaagcctgcatttccatattgccaatggcagtcaccatcacgatcggggtaaaagtatattcaaacctctcccgtatctctcttgcgaacaaaattccaccgatatcctcccggtcctcgccgcttagatttacatccaaaaggaaaagaccataccggatttcctgatccagcaggtcttttgcttctttcagggaagatgccttgtggacacggatatcatctgaatatgtggtaagaatctctgacaatgcctgcagcgaagtcagttcatcttccaggatcaatacatccgtcatctattgtcacctttcctctctctttttttaatctaatcttccttgatcacttctttagcgctctttacaagccccgcaagtgactgcagttctgacggaatgatgattttcgttgccttgccgtctgcagccttttcaaatgcctccagactcttgatcgtaagcactgcctggtctgcacccgcttcacggatgaaacggataccgtctgcatttgcctgctgtactttaaggatggcttccgcttcaccttcagcctctttgatcctcttttctttttctgcttctgcctggaggatcgctgcctgtttttcagcttccgctttcagaatcacagattctttttcaccttctgcaacaaggacagtagatttcttttcaccttctgcacggagaatagcttcacgtctttcacgttctgctttcatctgtttctccattgcatcctggatcgctgccggtggaatgatatttttcagttccacacgattgactttgattccccatggatccgttgccacatcaagagatgctcgcatcttcgtattgatcgtctctcttgatgtcagtgtctggtcaagttccagatcaccaatgatgttacgaagggtggtcgctgtcagattctcgattgccatgattgggttcgctactccgtagcagaacatcttcggatctgtaatctggtagaatacaacggtatcgatccgcatggttacattatcctttgtgataaccggctgcggtgcaaaatcaactacctgctcttttaagtctactcttcttgccacacgttcaatgatcggcagtttaaaatgaagtcctacactccatgttgcctgatatgcaccaagacgttcgataaccagtgcctttgcctgtggcacgattttaatgcaggaaatcagaaacagtaatgcgatcacaataataattactaaaataataagtcccgtcatcttttagtcctcctcatatttttttacaattaactttactccggatatattaaccaccttcgccagtgttccggggtccaggatcacgttatcctgttcggatcttaccgtccactctgtaccatttactaccgccataccagtctgccctatgttatctactttctggctgatccggatcgtctttccgatgattccttcatagttcgtcttcagacggcgggtgttaataaaacgcattgcaaatggtctggtaaatacaagcagtaaaattgtcacaataaaaaatgcaaccacctgtccggcaaacggtacatccagaatattcaggatcagtgccgccagcgcacctcctgctccccagatcgttgtaagtcccaccgttacgatctcgatcaccagaagtactaccagaagaaccagccatgcaacagttatatagctgtcctgaactgctcccatattcttcactcctttctgcttacagatatggtagcagagtgtctgtgtcaaatcaatcccttctgcgtgaatgcagtgatttcctgtgcgaataggttacgcttcatccttaatccgcttcatatgcgctttgatcgtttgttcgtagccgttatcgctcgcttcatagaatacggcatctttgatctcatccggcagatactgctgttttacataatgattcggataatcatgcgcgtatttgtaaccaattccatgccccagctttgcagaacctctataatgtgcatcctgcaaatgcaccggaacagtcgttttatattttttcacattgtccatcgcagcaaagacagcattacatgctgaattactcttcggcgctgttgccacataaagaactgcctgtgataaaatgatctgtgcctccggcattccgatccgctccactgcctgtgctgcactgactgcaacattcagtgccatcggatccgcatttcccacatcttccgatgcacagatcataatcctgcgggcaataaacttaatgtcttctccggcatacagcatctttgccagataatatacggctgcatccggatcagaaccgcgcatacttttaataaatgcggatatggtatcataatgattatctcctgtcttatcatatcgcacaacccgcttctgtatacattcggatgcaacatccagcgtgatatggatcattccatcctcacttcttggtgtggtgaggatacccagttccaccgcattaagcgcagatctggcatctccaccggcaaggtctgccaggaaatgcagggcatcctcctcgatcaccgcatgatagcttcccattccttttttttcatcctgcaccgctctcagaatcagggtctctacttcttcctgtgaaagcggacaaagttcaaatacactggatctggaaagaagcgcaccgttcacctcaaagtaaggattttctgtcgtcgcaccgatcagaatgatcgtgccgtcctccacaaacgggagcagataatcctgctgtcctttattaaaccggtgaatctcatcgatgaaaaggattgtccttttctggtacatccctttcagttctttcgccttattcaccacttcttccatatccttcttcccggcaaccgtagcattgatctgggtaaattctgcacttgtagtattggcgatcacctttgcaagcgtagtctttccggttcccggaggtccgtaaaaaataacagaactcagtttatccgccttgattgcacggtataaaagcttgtcctttccgataatgtgctgctgtccaaccacttcatccagagtcgtcggacgcagtctggaggcaaggggcgattctttctcctttgtcgtctcccgcatataatcaaataaatccatcaaaacctctcctttaatccagcagcaattcatcgactgtcacaaattcatatcccttcgcctgcatgatatcgataatgcgaagtgccgcctttactgaagacagataacagtcatgtaataaaataatatcattttcctccgtttccgtcactactttattgacaatttctgtctcgttatccgtattccagtcaagcggatccacattccatagcaccgcaatcatgccggtattctcttccatctccttcttccaggctccatagggcggtcgcatatattccgtcttttttccggtaattttttcaatcgcggtattggtctttccgagttcgcactctgtcattttctgagacatttttgtgagatctacatgactgtaagtatgatttccaataatatgcccttcttcagcctctctactcacaactttcggatattttactacattttccccgatcacaaaaaaagtaaccttcacattccgcccggcaagcccgtcaaggagcactggcgtactggaaggatgtgggccatcatcaaatgtgagggcgatcttgggcttttcctgatactgctcgtttgttccacctgcctcataggatgcttctaccgtttcatcgttcattcttatcagtttgatctttccgttatcgatcactccccaggtaaacagaagccatgtaaagcataaaaaactgattgttccataaagcagtcggtaccacatacgaatatccctcttttcccattctctttttactatatgcgggagattctttacctatgtactcacatttatgctttcttgcctccggtactcttgcattaaaaaaatatatacagaacaccaatctcttcctgttttctatactcagatcaaaaaaggggatatcaaccagcttctgctgactcatatcccctgaatgatctacattgcttttttataaagttcaacgatatccctgatcgtagactgtctcggatttgccatgatatttccgctcttcatggcatcagcagccatcagttcaatcttatcttccgttacaccaacatcggcaagatgctgcggaataccaagatcacgaagcagatctctcgcttcatctaccagcatttccggaacaaaatcgatcaccgggtctttttctttgctgatataattgtagatcttctcataacgtccatgatctgcaagtgcattatattccacaatcgttggaagaagaatcgcatttgccacaccgtgtgccacatggaaataggcgcttaccggatggctcatagcatggatatttccaagtcttgcccatgcaaatgcgatacctgcgaacatgcttccggagagcatggctgccgccgcctcttcgtcctgacggtttgctacgaatctgcgcagatttgcaccgatcagttccattgccttttctgccattgcatcagaaaatggagatgcatctcttgaagtgtaagcctcccatgcatggatcagtgcatctacgccacatgctgcggctaccgatgccggagaagtcataacaagctccggatccagaagtgcatagcttgggatcagctcatagctgaacacagtcagcttataatttcttgcttcatcggtaataacagaaaatgccgtcacttcacttcctgtacctgcagttgtcgggatcgcaatgatcggaacgatcggtcccggtaccttgtgtgcaccttcataatctccgatctctccgccgtattttgcaagaacacccactgcctttgccacatccatcggacttccgccaccgaaagctacaatactggttgctcctgcttttttgtatgcttctgttgctttatctaccgttgcaacagatggatttgcttctacatcagtaaatacttccacttcgataccggaagccttcacgatctcttcgactttctcgaccattccgatcttcttcaaaaccggtccggagatcagaagcatcttcttggaaccacttttctcaagaagctccggaagtctttttaaactgccttttccaaaaataatatcctgtggtacattgaatgtaaaatctttcatcatctactactccttttaaataagaatgtgcctcggcacattctcgcgccgagcgcgttgctgagcgccagtggcgctcgttaagcaacgaccgaagcagagcgtagaccgcttgcgacatccttcatcttcgtgcgagtgcgcatctccggtacgcagtgccttttgtttcataggaagttccttcggaatttcctatgaaaaaagacgagaccgcaccttagcagtctcgcccttgagtttctacttacacagcatataccctctgtcattttcttgtcaagaggattttctgtttttatttcttctttttctttccattcttctttgtcggctttttcacgctatagccaaatgttccgagcaacttacccagactataatactgtccgtgcacatatacgatcggatcggtcttttccaatgcaaatcgccctttctgatccatataggcatcatctacatgaaccgcttttacctcggcaaggaaaatatgatgcgaccccggtgtttcttttttgaccaccttacactcgatgttgaccggactctccgcaatcagtggcgcactcacatattctgccttttccggtgtcagatgcagctctttgaatttgtccacatcttttcccgaacgcacaccgcaataatccgttgcatacgcaagtttttccgttgtcagattgattacaaattctccggtctcatcgatcatgtgataagaataccgctctggtctcacggaaattgaaaccatcggcgggtttgtgcagaccgttcccgcccacgccacggtaatgatattcggattgccttctttatctgccacactgaccataactgcaggcagtggatacagcatatttcccggcttccagatctgtttttccataagccatctctcctataaagttatctgtttttatttttgctgcaggtaagttaccagaacagggatcatctgtttctttcttgatactacacctttcaggagaattttttccgtatctcccggcagttcaaacgcttcaagaacctgttcctttgcattttcaccacagcaaaggagttctgtagactcttccagaatattagtcatcatcagatacaacatatgcagtccctgggtctttctcgcctcttccagatatgggatcagacgtcctttcacctcatccagttcatcctgattcatggatgtgatctgtccgactccaaacatgatatcttttacattgaacaccttaaagtcctggaaacagatctcttctacggatttgccacgcagattgcttcccgcattgaacatctcctttgcatgttctcccatatcaatcccggcaatccgcgccagtgcctctgctgccgcttgatcaaccatcgtacaggttggtgaacggaacagtaacgtatccgaaataattgcagagcacagaagtcccgccatctgtggctctacctctacaccgctttcctgatacatctggtaaatgatcgtagcggtacatccaaccggctgattccggaaatataccggtccgattgtctccagaccgcccagtctgtgatgatcaatgatctcctgcacctctgcctcttcaattccattcacagcctgtgatttttcattatgatccacgagaatcacctgttttttacgggatgtcataagtcttcgtctggagaggaaaccacagaactttcctttattatccagaattgggaaatctctgtacttcgtctttgacataacttctttcacatgttccacataatcattcaaatgaaaaatctccagattatcacggctcataaaatacttgaccggaatactctggttgatcagccttgcagcagtaaaggtatcatgtggtgtctgaataatcacgatatctctctcctctgccatcttcttgatcgtcttggaaatattggctccctggcagatgaccagacagcttgcatccatctcgatcgcgcacagctgtgactcataacggtttccaagaatgacaagatcatccttctcaataaaattctccatcagatccggactggatgcggcaatgacaacttttccattcaggaaatagccatgctcattcccggagatcagtgttccgtccagtgttttgacgatattgcggtactgggttctcgctgttgcaaggatattattatcgtacacttccatatatgacgtagcaatatctccgatagtgatcagcccttccagcttctcacctcttgttaccggcagtgtcttaatattctcatctttcattcttgcccatgcgtctttaatggacatgtgaccagatacaccctcaatatgacggatatccatatcttttacctgaaggtgtacattgtccagaagagacggcacacttacctggaatttatccagaacatacgctgtctcaccatttacctcgcccgctcttttcgctatgtatttttctcctgtgattttatttttcagatttgcatatgcaattgccgaacagatagaatctgtatctggatttttatgtccgatcacatatactttctttggttttttctgatccattttatattactccattactatcccttgttcctttacttttcagaatgccattttttttactgttcgtcaacccttgttcgaataaaagaccacttacagtgaattttaaacaatatctctaccagtgccttcggtctgccacccgctgccgctgtcttctttgcatacacttttccataatcggcttccatgatcttattcatgatccggcgcgcacttctgaccgtaattcccaggcactccgccaactgatgtgcatcgaaaatataactttttcttacatctgcaatggcaatgatcttcaggtttccgcgtcattcatcgtgcctccggttccgatccctacattcaggctgattttattttcttcttcctgatgcaaaaattgcaccttgaatcccttctgtatatttgatgatttctttttcaatatctgcttttgcaagcatacttgcggataccggtggcatacatccgtatacaactgagataacaagtgccggtccaaaacatgtaatgatacctaataacatggtgatttttccccatttgacaataccatgaaacaggtgctcccattgatacgatcagggagatcattgttaccaggactacgaatccatactttttatctatacaaaaatgtgttatactaataaacatattgagcatacgttcagaaaaataaactaacagaggtgttaagatggaaaacgaaaaattacaggaacagacagaaagcatggcagactacgaagcacatttcgatgatgccaatccatggaatgtggtcgcacgttatcaggaagaaggaaccaatcttcacgtaaaagtagaaggaatcgtaaatggtggtgtcatcgccatggtcgaaggacttcgaggattcatcccggcatcccgcctttctctttcttatatcgaagatctggagacttatcttctaaaagaaattgatgtccgcgtgatcgaagcaaaccaggcagaaggacgcctgatcttatctgcacgtgagattttaagagaacagaaaaaagcagaagatgcaaaaaaacttgcatctgtacaggttggaagtgttgtaaaaggtaccgttgaatcgcttcagtcctacggtgcttttgtacgtctcgagaacggtctttccggtctggttcacatttcccagatcagtacccagagaatcaaatcagcagatcaggtacttcacgttggggacgaagtagatgtcaaagtcatcggtatcaaagacggtaagatcagcctcagtatcaaggctcttgccgaagatgctgaaaaagaacaggaggaagagctggaacacgtagaaattccgaaagtagaagcaatcggaaccagccttggggatctgtttaaaaatatcaagctttaaaaattataatttaaaaaagggaagcctgcactttcgcagacttccctttatcattgcctgataagtgtcactgacactttatgcgagaatgtaccccctgtacattcttttctatttctccagtgcttccagatcctgcatccagactgccgcacacgcatcgctcggcattctccagtctcctctcggtgaaagtgccaccgtaccgatcttcggtccgtccggcaggcaggagcgcttaaactgctgcgcaaaaaatcttcggtaaaaggtcttcagccatttcatgatcgtctcgttgtcataagttccttcaaatgcaagctttgcgagccgatagatctttgacggttcaaagccaaatctcagaacataatacagataaaaatcatgcagttcatacggacctacaaggtcttccgtcttctgggcgatctcgccatccttcggtggaagaagctccggacttaccggtgtgtcaagaacatccagaagtacctctttcagctcctgatcctcacaggtatccgcataatactgaaccagatgacgtaccagtgtctttggaacagatgcattgactccgtacatagacatatgatctccattataagtcgcccacccaagagccagctccgacatatctccggttccgatgaccatgccccattcctggttagcaatatccatcagcacctgggtacgctctcttgcctgtgaattctcataggtcacatcatgtacctcttcatcatgtccgatatcacggaaatgcacatggaccgcatccgcgatcggcacctctttcaaagtggctcccagcttcttcgacatcaggcaggcattctgataggttctgtctgtcgtaccaaagcaaggcatcgtcactgcaatgatatccttgcggtcttttcctgccatgtcaaacgctttcgccgtcacaagcagtgccagcgttgaatccaaaccgccggaaattccaacgactgctgttctcgagtgagtatgcaccagacgcttcttcagtcccattgcctggatcatcagaatctcctcacagcgcttttccctctctgccatattctgtggaacaaaaggggtctgtgcaaagcttctggtaagtgctgtctcttccacacttatgtggaacagtacttttggaagatgacgttcttccgttgtctggaaagttgtattttttctccgttcacttaaaagacggaaaatgtcaatctcactgacgatcatctcgttagcaaaccgctttgcttctttcaggattgtcccattctctgcaataatattgtgtccgccaaataccacatccgttgtagactctccgtccccggcatttgcatagacataacctgcaatcagtcttgcagactgtcccttgatcagttcctcccggtaactatcctttccgatcgtctcatcacttgctgaacagttgaccaggatgatcgcgccttctcttgccgcctcaatgctcggcgggattggtgaccagacatcctcacagatctctgccgatacgaccagatcatccatctctgccgcctgatacaggatctgcggcccaaacaggatttcctccccttcataagaaatcactcttgcttttttcggtccctgacggaattgacgcatctcataaaattccccataattcggaagaaatgtcttggttgtaaagccaaggatctttccgtcatttaatgcagccgcaacattataaagctctccatcaattgcaagtggaagtccaacaaatacaagtgcttctgtatgcctggtctcttctgcaacttttgcaagtgctctgcgcacctcttttaacagtatatcctgtgtaaaaagatcgctgcaagtatacccggtcaggcaaagctccggaaaaacaatgatctttgcaccagccttttcagcttctttcatacgtttgcagatttccttacagttgtgccagacatccgccacacgaatatcaactgtgaccgctgcaactttgataaatccctgtttcatgtgtttacctctttatctttttgcctgttttaaaatctgtttcagctcttctacactaaatgtatacgccgtattgcagaaatggcattttacttctacttcttttccgtcatcgatcatttcctggatatctttctttccgatgctgatgatggctttctcgattctctcatgcgaacaattacatttaaactgtgtatccattgtatctgtaaattccacattcaggccatccagtacctgctccagcatctgctccggtgtatgtccgttatccagcatactggtaacagaagaaatcttcttgatattctcttccagtttatccagcacctcatccgatataaacggcattacctgcacaataaatccacctgcacagtgtacagtgttgtccttgttcatcaatactccaaggcccacagacgacggaacctgttcgctggttgcaaaataatacgtcagatcttctgcgatctcacttgtctgcagaatagtctgtccaacatatggttctttcagtcccatatctttaataacatttaaaagaccgattccaacagctcctccaacatccagcttgccattcttaggcggcatcattgcttccggatgatcgacgtatcctttcacgtcaccttttgcatctgcagtcaccgtaattccgccaagtggtccatcacctttgatctgaagcgtcagcacatctgtctcattcttcatcatgcctcccatcattgctcctgctgtcagaagtcttccaagtgccgctgttgctaccggacttgtgtcatgtctctttcttgcctcttccaccagatttccggttgttgcggcaaatgcacggatctgtccgtctcccgcagttgctcttacaatataatctttcatataacaattctctcctgttctattttccctgttctcttgcgatcacataaatgcgctcgcttgtgtccatcggcgcattctttgaaaatgcatcgtatgctgtcacaaattccagccccgacttccggatcagttccttcatctcctccagcgtatacgctctctgataatgcgtctcctcatatttgcgataaagcccactgtccttatctgtctcaataaaaagacttagatcatattcattgatcttctcatcttcgtaataatagttgtcccagataaaactgcattcctcccggttctccgcaattgtgcgatccccaagaatctcttcatacttgtaacgtgtattaaaatcaaaaataaaaacacctttcggatccagataattgttgaccaggcggaatacttcctgaagttcttccggctctgtaatataattgaccgaatcgcagacactgatgacagctcttaccgtaccatacagttcgaactctctcatatcctgcagaagatacagaatatcatgaccggatttgtctcgtttctccattgcgatctccagcatctcttccgcattgtccgcaccaatcatatcatatcctgcctttgcaagcaattctgtcatgttcccggtaccgcaccccagatccagtaccagtccatccctgacaccatattctctcataagaccggtgagatattcacaccattcttcgtagggaatattatccatgaaggtatcatatacacgtgcaaagcttgtatacgcttccatactctgttgttcctctctttcgattcgccatcaatgcccataagcagcactgaccgatgtccacggaccactccgctgcgcatcctgacatccagattattttatagtataacacaggattttcctctaggaaagtcatattctgatgagaacttttcccttttggaattttctttactgttcacagtacctgtgaccagtaacgcattttctttttcagacgcaaaaaagaatgtgccttggcacattctcgcgccgagcgcagtcgcttgcgactttcttcatcttcgtgcgagtgcgcatctccggcacgtagtgccttttatttcataggaagttccttcggaatttcctatgaaacaaaaaagaaccaggggaaattccctgattcttttcgcattttttagaatcccagttcttcattcaccagaatcacttttattctgtttggaacatggctgaatcttgtaatcagtgtctgacagcagatacttttcggagatttacagttggaacagacacctgtcttcgcacacggaagcccttcaaaacgctgtccgttaatcggagctgccacatactttgcacgggcatatgcatcctctgcacttcttacaattttgttcatgccaacgatcatcagaacattttccggtccgtaagaaatagctgccacacggtttgcatttccatctatattaaccagtatcccatcttccgagattgcattacagcttgccagaaaataatcgcagttaagtgcctgatgcatcatctctgctttttcctccggtgtcgcacacagatctctgtccagcactttataatttcctttatgaagtgcttcaggaagaccaattgccttaatgctcatagaccctccccaactgatgctgcttccttccggaatcagctccagtgcaagggcaagtgcctcttctttggtctgtacataatgtccctccatctgacgggacttcaaattctttatcacctgctcagcgagcagatcatttcgctttgtaacgaatttatccattattcaaccacctggatccatccttccggtgcttcgatgtgtcccatctgaattccggtaagtgtttcatataatttcttgataacaggtcccatctcatccattccgcttgggaagcagatttctttaccatgatctacaatctttccaaccggtgaaataactgctgctgttccgcaaagtccgcattctgcaaagtcttttacttcatcaagatatacttctctttcttctgtctcaagtccaagataatgttctgccacataaagaatagaacgtcttgtaatagatggaaggatactgtttgacttcggagtaactactttaccatcttttgtgacgaagatgaagtttgctccacctgtctcttctacttttgttcttgttgctgcatccagatacatattctctgcatagccttcttcatgtgctgttacaattgcatgtaagctcattgcatagttaagaccagctttgatatgtcctgttccatgcggtgctgcacggtcaaagtctgagactttaattgtgatcggctttgcgccgcccttgaaatatggtcctactggtgttacaaatgcacggaactgatattcgtcagcaggtttaactccgataaccggattgcttccgaacatatatggacggatataaagggacgcccctgatccgtaaggtggtacataagcctcattggcttttactacctgtacgatcgcatctacaaaacggtcttccggaaataccggcatctcaagtcttcttgcggaatcagcaaatctctttgcgttcatatccgggcggaatacaacgatgcgtccgtcttctgttgtgtatgccttcataccttcaaatactgactgggaatactgcagaacacctgcacactcattcaatacaatgttggcatcttctgtcaggcatccatcatcccactttccatctttgtaatttgaaacatatctcttttcggtcgggatataaccaaatcctatgcttgaccagtcaatctgtttcttttccattgtaattcctccattcccttgttgcttcttacagtaacatatatctaaattataatttttgcttcccgtattttaaatcctacggattacatatcgctattatattacttctgtttttcaaattcaagagtgcgctctgttttttttgatttttttatctttttggcattgtgatcgcttcaatccccacacttccgcctcttacaacttcaattgaattgaattcagaacgtaaaaactggatgatcgctgtatttttatgtgccgtgtgtacaaattcaagaagcacactgtcttttccataatcacgtacctttgcctgataggtctgcgcgatctggaaaagctctgtcttatcttccggtgtacagttttttaccttgataaacatcagctcctgcataacaacagatacttctgtaaaatcaatgactttgatgacttcgaccatacggttcagctgttttttgatctgctcataagtctcttcatcactgttcgtctcaatcgtcattctggagatagtcggatcttctgttctacctaccgtcagactctccagattataggatttaccggaaaagagtccggaaatctttgaaagtacaccaacctgattttccacatataaggaaatccatctttttttcattgtattatccatcttcacctctcctctccattaatccatcaaaagatcttccagggttccgcccggacgtaccatcggataaacctgcacttccggatccagcatgaattcgatcagagtcggcaccttcagtgcacggtttgcttttgcctgttcaaatgctgctttcatctcggatttttcggttacacggattccctttgccccatagctttctgcaagttttacaaagtccggcgtatatttcggtggatgctcttctccacgtcttgtcgctgcgcctgcacgaagatccgtcatagaatagcgttttccatagaaaagtttctgccactggcgaaccattccaagataggtattgttaaatacacagaggatcaaaggaagttcttccagcactgctgttgcaaattcctgaatattcatctgcataccgccatcaccggaaattgcaatcaccgtactgtccggattaccaatctgcgctccgactgctcccgggaatccatatcccatggttccaagtccgccggacatataaagtctggtcttttcattcacttccagatactgggatgtgaacatctgatgctgtcctacatctgtcacaacaatcttgtcatcctctttaaacacttcattgatcgtctccagaatatcctgagcctgcatctggtctccctttggtttcatcctaagcggatgctcctctttccagccttcgatctgttccacccagctttcttttttctccattggttctacatattccaataatttttcaattgcttcttttgcatccgcaacgatcggaatatctacctgaatgttacgtgagatggaggaagtatcaatgtcgatatgtacgatcgtagccttcggtgcaaatgcatgcagttttccggtgatacgatcgttaaatctggtcccgatcgagaacagcagatcacattcttccactgccatattggatgcatatgcaccgtgcatccccaaattaccgataaaaagcggatgcgttgtcggaatcgcaccacgtcccatgatcgttgtcacaaccgggatctgggtacgttctacaagttcggtaaacgccttattcgctcctgcaatatttaccccaccaccggcaaggaacaacggtttctttgcctttccaagcatcttgactgctctcttaagctgtccgatgtgaacaccggtactcggcttatatccgcggatattgactgtctccggataattcgggcttccaagctctgccattacatctttcgggagatccacaagaaccggacccggacgtccgctgcgcgcaatatagaatgcctctttgatgattcttccaagatcttctctctttcttactgtcacaccgtattttgtgatacttcttgtaatacctacaatatcaacttcctggaatgcatcatttccgatcagatgtcttgcaacctgtccggtaaaacataccagcggtacactgtcataatttgccgttgcaattcctgtcaccagattggttgcacccggtccgcttgttaccagacataccccgacttttcctgttgatctggcgtaagcgtctgcagcatggacaagtgcctgttcatgacgcggaagtacaacttttgtgtaatcctgtttgtaaatttcatcactaatatcaattgtacaggctcccggatatccaaaaaggatatctaccccctcctcttttaatgcttttacaagtaatttgttccctgatatttttttcataaatctacctccatgaattttctatacagatgatcgccaaatttttatcatagtcatatagaataacaaacgccctaaacggctgaccgttcagggcgaatataaaatccgtgttaccacctgtcttcagagaagctgcttctctgctctcacgcaagtacagaaccatagaaatgttcgatactattcccctgtaacgtagggcctacgtcgaagtctacttgagaaattcccgttcggtccgctgctcaaaggctacttctacaatcccttcatgaaggcttacaccgtccgccttctctctttgcttccgaagattatatactcctccttgtcatagcatttcttctattgtctcatcgattacatttattataatgagtggtctattgatttgtcaatgatacatttcgcaaattttattgatctattttattctttcatattttgcaaatacatactcaagatcgaaatatgtctgttcatccgtctcagctgttttttgccaatccggatccttatccagatccgggaaccaggtatctgcctcatatacatgatctgtccgcgtaacatacgctatattacaatacggaagcattgcacggtaaatactttctccgccgatcacaaagacttctcctttgtgctttttacattcctgcattgcctcttccacactgtgtaccacgatcgcatccttcacctgataatccggattgtgggaaatcacgatattaacccggttggcaagcggacgcccctgcggaaagctttccagtgtctttcttcccatcacgacaatattgccttctgtcatctgacggaagtatttcatatctgccgggattcgtacaagcagactgttattctttcctattgcccagtttttatctgcatttacaataatgttcatcgtatctgtctccttttctaaaccgcgatcggaatatttttgatctgcggtcctgtcacataatcgtctaatcttacgtcatccggtgtaaactgatagaaatctttcacttccggattcagccagaatttcggtgccgggtgcgtctctcttgaaatcagttcctcgatcagcgaaatatgcctgtcgtaaatatgtgcatctgcgatcacatgtacaaattcgcccacctgcatatcgcatacctgcgcgagcatatgaagcagcacagcatactggcatacattccagttatttgccgccaacacatcctgggaacgctggttcaggattccgttcaatgtcagcttgtcgctgcccttttcttttgtcacattgaacgtcatgctgtatgcacacggataaagattcatctcatgaagatcttgatgtacataaatattcgtcatgatccggcggctgtaaggattattcttcagatcatagagtacacggtctacctgatccatcattccttctttgtagacatgctttacgcccatctgatagccgtatgccttcccgatcgatccatcttcatctgcccagctgtcccagatgtgactgttcagatcgtggatattattggattttttctgccagatccacaaaagctcatccgtacagcttttgatcccggttcttctgagtgtcagtgccgggaattcttttcgcagatcataccggttcaccacaccaaatttttttacagtatacgccggagtcccgtcttcccatctcggacgtaccttttctccttctgtgctggttccattatcaatgatgtccctgcacatctctataaaaactttgtctgcataactcatgcctgattactcctttttccaatgctgtgccttttaatattctctgataatgctgctgatctcacttacgatcggcatttcttttaattcctccagtgcatcctgaagatggtattccttgactgcggatgttccgatgacaagttctgcctttgccgcttttgcctgttcctggatcacacgttcgatacttaccttatgatctccgaatactttcgcgattgctgccagtactcccggttcattactcacctgcatacggataaagaaacgattcttgacgtccgcaaattccttgatcggaagctctttgtatgcgctccatccgattcttccggtacagttccatacaatatttcttgtaacatccatcacatctccgacaactgcacttgcggtcggcagttctcctgctcctcttccatagaacatggtatccccaactgcatctccgtgtacaaaaacagcattaaaggaatctcttacggtagcgagcggatgtttcttatcgatcatcatcggataaacacctgcttcaattccattagatgtatttctcgcaataccgatcagtttgatcacatttcccatctcttttgcgtaatttacatctgctgctgtgatctttgtgattccctccgtatagacatccgaaaatttcacctgcgaatggaatgctgaggtagccatgattgccaccttacgtcctgcgtccagaccttccacgtccgccgtcggatccgcttctgcatagccaagctctgtcgcctttgcgagtgcttctgtgaaatccattccatcttcaaacatctttgtcaggatatagttggtcgttccgttgacaattcccatgatctcatcgatctggttgccttccaggcactgcttaagcggacggatgatcgggattcctcctgctaccgctgcttcaaacaggaaatcagcgctaccttctttcgcagcgtcatagagttcctttccatattctgcgatcagatccttatttgcacttactacatttttccctgctttcagtgcttctgtgatcatcgttttcgctggctcaattccgcccatcacctcgatcacgatttggatttcatcatcttctataatctctttccactgatctgtcagcagattctgatctacaccctgtcttacttttttcatgttgtgtaccaggattttctttatttcaagagcggcgccggtcttctgctgcatctcttcactgcggcgtccaatcaatttataaacacctgttccgactgttccaagtccaagtaatcctactttgattgtctttgtatctgtcatatcttcgcgtcctcctaatctatagtaaatccattttattctagcacttttttgtaaatattcaaagaactttcttgacatcttttggggacgtgataacattataaatgtatgattctatgtatttaaggatgtgaatgttaaacataatttttaacatttacatcatttaataagggagtagatacatattaaaaaaccaaagaggagagataaatcatgcagtgcccgatttgtaaaaaggatcttgagatcaagaacaaaaaaataggcgaaaatgaagccggtgaagcaatctacaatgaattcgcaatctgccgcgattgtaaaaagcagtggaatttagataaacagcgtgaaaagaaaaaaaagcttgcaaaagaagcattggctgaaaaaacagttgaagccggtaaggctgcagaaaagccacacaaaaagcgcccggctgccgaaggcgaaaagacttctgccgaacgtcctgcccagccaaagaaaaagaaaaaacgtccggtatctccggaaaacgccgaaaagcggaccgcttcttctgctaatccagaagtaccggctcatccgaagaaaaaacgtccgaacccggctgccgaaggcgaaagaccggtaagaaaacctcgtccgaagacagaaggttcttccgaagaacagccatccagaccgcatccaaagaaacgccctgctacttcagaccgtccacttctcaaatatgcagaaggtcaggaagaaagccgggaaaaagttcgtccacgtccgaaaaagaaacgtccggaagaagccaaaccgatacatgcaatagacaattccagcacacgtatcatttctaatgaagaggatgaacttaaaattactgcacctgatctttccactccagaaggagaaaaagaacagacctattctaatatcccaccaaagcatgtccgtgaaaaacgtgaacaggagatgcgtgagaactatcagaatatgttagacgaagaagatgacgatgatgagagacattttcctgttgtgcttgttgtaatccttatcttcctgatcatcgcagctgctgcatttgcaggatactggttcttcctgaaataaaaaaagaatagttatgatgaaagactggctcgatgccagtcttttttacgttagtaatgagccagggtttcgtgtgaacacgaatccccggcgaacgtacaccatctcgcttagcagctcgatgatgtacattcgccaaatacagatttttacacccatgcagatccttgtgcaagcacaaatctgcatggataccaggggatatttatagttagtaatgagccagggtttcgtgtgaacacgaacccccggcaaacgtacaccatctcgcttagcagctcgatgatgtacattcgccaaatacagatttttacacccatgcagatccttgtgcaagcacaaatctgcatgggtgcaaaaatctgtatttggctcattgtatgcacaaaaaaagaaccacacgcaacatgtagttcttaattcaagagcgacagacgggactcgaacccgcgacctccaccttggcaaggtggcgtactaccaactgtactactatcgcattcagtatttgttgttcatcagaacaataaatactatacaatatatctatcaattggtcaagtatattttcaattttatatgtcggacttttctacctgtcttcgcctattattctgttaaaatcattttttgtctgattaacagaaaacttattgaatctccgcaaaaagtagaacagaatttcttcattttttcgttgacaattccttctttgtacggtatagtagatattgttctgatgaacacaatttaatagatgcgatagtagtacagttggtagtacgccaccttgccaaggtggaggtcgcgggttcgagtcccgtctgtcgctctttgtgagacttatgattttcataagtctcttttttcattcatgtaaatttctgattaaacttttaattaaatcaaaagcccccatttgtcagagttgtgccagatacacgaaaagggatccgctttcactttttttgcaaaagcctgatcccttctttttatttattctaaccttatagatctactcttctattttgccagccagtccattgcaatcttcgcatacatggctgcgccaagcggtaatgctttttcattaaacagaatctttggattatgctgtcctttccatttactctgatcttccactccggctccgactacaaaataacttgccggtatttttgctgaaatcacggcaaagtcttcggatcccatgacatgaaatccacagttaatcgttgttcccggattctcaagagactcaacacttttaatatactctgcattcagttcttcattgcaagttacactcggaacattgctgagttcttcaatttcacaagtagtacgataagctgctgcaacagccggaacaatttcattgatcctccggatcagcatcgtccttacttcttcattaaatgtccttagtgctccctgaagcacgcagcgctccggaattacatttgctacattaccagctgtaaactgtccaatcgtaattgctgcctctgctgatggtggacattccctggcaatcagtgcctgaagagcatgataaacttctacaccagcgttgatcgggtcaatgcagccctccggtgcagaaccgtgtccgccacgtcctgtaagggtgattttaaagccatatacagatgccatggcttccacaccatatccaatcgttccatatggaattgccgcaaatacatgcgctgcaaaggcagcatctacatgcggattctccaggactcctgcttccactgccgctttcgctccgcggaaggtctcctcacctggctggaacaataatttgaccacgcccggcagttcttcttcatacgcctttaaaatttttgccgctccaagaaggatcgtagcgtgcagatcatgtccgcatccatgcatacagccattctttgatgcaaattcaagtcccgtttcctcttctaccggaagcgcatccatatcatttctcagaagaaaacatttatccccttttccaatctgagcgataatcactgaaacctcaggaaataccttgtattctacattcatctcatccagacgtttactgatatattccaccgtctttgaaaactccagatccgtctcaggaatttgatgaagatctcttctccattttataagtagatcattcatttcctgcgcttcttctaaaattttatgtgccatatatcccatcctccttttatttcaactaccgttattatagaatttcgctataaaaaaaatgaacatttcttcactttgacagccaattctgttttatgtgaaaaaatgttcatttttaaaaattgaattataaaatttattcagcgtccgctgtatgctcttccagctccagtccaagctcttccaactgcttcggatcgactctctccggtgcttctgtcatcaggtcagatgcatcttttaccttcgggaacgcgatcacgtcgcggatgctatcctgttttgccatcagcataaccagacggtcaagaccgtaagcaagtcctgcgtgtggcggcacaccgtatttaaatgcattcagaaggaatccgaactgctcctgtgcctgttccggtgtgaatccaagtacttcaaacattttactctggatctcctggttgaagatacggacacttccgcctccgatctcgttaccattcagaacgatgtcatatgcttttgcacggactcttcccggatcactgtcgatgtactgaaggtcttcttccatcggcatggtaaacggatgatgcattgctgtgaaacgcttctgttcatcactccactcaagaagcgggaattctgtgatccacaggaatttatattcattcttatcaaggagttccatctggcgtgccagttccagtctgagtgcaccaagaacatcccatacaactttattcttatctgccgcaaagagaagaaggtctccattctctccagccatcgctttaatcagcgctgctgtctcttcttccgtcataaattttgagaaagaagatttgacagttccgtcttcatggattgcaatataagcaagtccctttgctccataaccttttgcaaaatcaaccagcttgtcgatcttctttctggccatgccaccctgaccttttgcgttgataccacggacagttccgcctgcttcaatcgcattcttaaatacaacaaattcgctgtctttgacagtctctgtcacattaaccagctccatgccgaaacggatatccggtttatcagaaccgaatctgtccattgcttcctgccaggtcattctctggatcggaagctgtacatcgatatccagtacatctttgaacagatgtgcaagcagtctctcattgatatcaatgacatcatcaacatctacaaaagaaagttccatatccatctgtgtaaattccggctgacggtctgcacgaaggtcttcatcacggaaacattttacgatctggaaatagcgatcatatccggagcacatcagcagctgtttgaagatctgcggtgactgcggaagtgcatagaagcttcccggatgaatacggctcggtaccaggtaatctcttgcaccttccggtgtactcttgatcaggaacggtgtctcgatctcaaggaatccttcttttgccatgaactgacgtgcgagggtagccacacggcttctcatcatcaggtttctctggatgtccggtcttctaagatcgaggaaacggtatttcagacgtacttcctcttttgtcttggaattctcttcgattgggaacggaggtgtctcagattcagataaaattctgagttcttccggtttgatctcaatcgcacctgttgcaagattttcattaactgcaccggaacgtttttcaacagttcccacgattgctacaacaaactcacttctaagctttgctgccttctcaagaagcgctttatctgtacttccctcttcaaaaacaacctggatcagtccggaacggtcacgtacatctacaaaaaccagtccacctttatttctgttcttctgtacccatcccataatggttactttttcaccgatgtttgcctctgaaagctctgcacaccgatgtgttcttttcagtcctgtcattgactctgccattctaatttatcctcctgcgtttctctttccttataaatccataacggaatctttgtagcagtctgtgatatcttcatatccttctgcgatcagctgatccttctggaatttcttgtttttcttcatattgaccaccagaacctgtttcccggctgcgcggtcagcttttgccatctcaagtaccttgaggatgccttccttatgcatattcttttcaagaagatatgcttttttctggcgcttggaaggaatctcatatccattttccagaagcagcatgacaatacgctcaaatccgattgagaatccacatgccggtgtgtcctgccctgtgaatttaccgatcatcttatcgtaacgtccgccacccgcaacagagccgccaaattcatccatcgttacttcaaaaatggttcctgtatagtaagattgtccacgtaccagcgtcggatcaaattttactttgaaatctgcctcttttgcactttctacgctggaaatgatcatttccatgctgtcagctgtcttctcatcaaggaatcctgccagcttttctttgcagaaacggattccatcaacatccgggttgatctcatcaaagagtccaagataagtatctacattttcttttgtataacccatctcaaccagttcttcgcctacgccttctttgccgatcttatccatcttatcaaggatgataaatacttcgtcgaaatcttcttccttaaatccactgaatgcagccatcgcctttaagatattacggtcattgatacataccgtaaaattgtggaaatccatctttccaagcatggtcgtagttgcaaggatcagttcgatctctgcaagattacccggctcacctaaaatatcgatatcgcactgcatgaactgacggaaacgtcctctttgtggacggtctgctctccatacattgccaatctgaagcgccttaaacggtgacggcagttcatttgcatgatttgcatagtatcttgcaagcggaactgtcaggtcataacgaagtcctccgtctaccagatcgatctcttcttttgcctcagcaattttcagtttttcccctctcttcagaatcttgaagatcagtttttcattgtcgccaccctgtttgctgcacaggttctcaatgtgttccacacacggtgtctctatggaagtaaatccaaatgtcttataggtatccttgatcatctggatcacataatctctgatttccatttctttcgggagcatgtctttcatgccggtaaccggttttttctttaatgccataaccattctccttttcgctctatcatctcatcgatacgggaaatatattctcccacatctctgacattttctattcttatcagattcgtcatccgcccgtttttacttccgggcgccggaatctcatacggaagcaccaccttagtcgatgcgcctgcaccggcagcaacgatggactgcttttcctccataatcagtatattgtaaattcccgctttgtcaacctttgcgtaacctacattttcaaaatttcctgcaatatttttctgtctgtagagataatacggataaagtcccatttcaccggccgccttacgtgccatatcgatcatctcttccagctctcttgccatctgtttgtaattttgtttttctgcgcttgcagcccgttcgcgtgtcagtctcgaaccatgtttcattgcaagtgcatggaccgtcaaactatccggtgcaagctctttgatctgacgaagagtatcttccatctcctccggatgttctcccggaagacctgcgatcagatccatattgatattgtcgaatcccagttctcttgccagatggaaaatgcggactacatcttccactgtgtgacgtcttccgatcacatccagtgtcttctgctgcatggtctgtggattgatggaaattctgccaactccatgctttcggatcactcgcagcttgtcctcagtaatactgtccggtcttccggcttcgatcgtatattctttcagatgttcaaaggaaaaatgttcttccaggaaactcaaaacccgatccatctgctgtgcactcagggttgtcggcgtaccgcctcccatataaatcgcattaagatgcttttcttttgaaacctctgcaatgaatgcaagctcttttaaaagtgcatctacatattcatccatccggtcctgccattttgcaaccggataagaagtaaaggagcagtaactgcaggttgtcgggcagaacggaattccgatataaagactgtatccattttcataatccagcttgtcaagctgggctttttcccgctttgcaatctcgatacctagcattgcttttttctcgcttaccacataggtatcatgcatataccggatgatttcttcctcagaagaaccttcttccagtctttccatgatcatctttgtggggcggacacctgtcatattcccccatgcatgttcttctccggtctttttgaccagggtctgatataattttttattgatataacgcttttgttctcttttttcgctgatgtctgcgatttcagcctccctgcaatgaaaaaaggtccaccggacctttttatcacatgcctgctcttccagatctggttcctcttctgcggtcatttcgatcagaagttcctgttctggatctaccttctggctgatctcggcatcaggaagaaatgactttacgatatgatacatgtcgtaggtgaaacgttcattcttacagctgatccgaatcatttctctgctcctctatacatacgggttgttcactttttcgttgccaatcgttgttgcgcccatatgtcccgggaatacctttgtttcatccggaagcaggaacaacttttccttgatcgaacgaatcagtgcagaagtgctgctggttgcaaaatcacttcttccgactgaacaacagaacaatgtatctccactgaaaagtactccctctttttctacatagtaggatacgccgccatgggtatgtcccggtgtatggatcacccggaaatcttctccgatcagatgaagcacatctccatcatggatcacgtctccacccgggtagctatagccatttgtatataccgttgactcattcatagacggtgtgtgaagaagctccagatcagattcttctacgtaaaccggcatttctccataccggtcgatcactttatcgattcccatgatatgatcaaaatgcgcatgagtcagaagaattgccttaattacaagctcttcctcttcgatataaccgatcatcgcttttgacaggtttgccggatcaacgatcacggtctcttttgtttcttcattagtaacaatgtaacaattggtactgataattcctgttacaaatttttcgattttcatttctttttaccccactgctcgttctatatccagcacgccgacgatctgccggagctttccaatcacttttccaagctcctctcttccccggacaataaatccggcttcgattgttgctgttccctgtttgctggttcttacattcatagacttcacatcaatattcatctccgtgaacaccttagacatatccatcagaagtccctgcctgtcatttgcatacatcttgatctcagccagatagcttccggtatctgtaccttcctccggtttttcccattctgccggaatcagacgcgctctttccgcttctgacagatgaatgatattgacacagtccgtccggtggatcgacattccgcgtccgcgggtgataaagccaacgatctcatctcccggcaccggattgcagcatctggaaaaacgcactgccatatcgtcgattcccttgaccacgataccactcttggatctggtgatatgcaccttgttctttgccgcttccgcaaccttttccagaacactttcgtcggtcagttcttttcggtgatccttactgtattcttctgcaagacggttgacgatctgcccttccttcaatccgccatgtccaagtgctgcaaggatcgaatcccagtccttaaaaccgtacttttcctgcacgatctgcatatatttcagtttcatcagatccgagagtacaaatccttttgccttacagtacgtggcgagcatttccttaccacgtacaatattttcttctttgaattctttcttaaaccactggttgatcttgttcttcgcctgggtactcttgacgatactcagccagtcacggctcggtcctttggagttctgcgaagtcaggatctcgattcggtccccgttctggatcttgtaatcgatattgaccagcttgccattgactctggcacctaccatcttgttgccaaccgcagtatggatcgcataagcaaagtcaaccggcgtagaaccgttcggcaggttcttgacatctccgttcggtgtaaagcagtatacatcctctgcaaatagatccaggtctcctttcagaagattcagaaattcccggttatctgacatgtctcgctgccattccaggatctgacgaagccagctcagtttctcttcttccttcgcttcaacgctcttctttccatcttcagactctttatatttccagtgtgccgcaataccgtattcagcagttttatgcatctcttttgtacggatctggatctcaaacggctgaccgatcgaactcatcagagtcgtatgcagagactggtacatatttgccttcggcattgcgatataatctttaaaacgtcccggtaccggtgtatacatctcatggataactccaagcgccgcataacagtcttttacagaatctacgataatacgtactgcaaacagatcatagatctgatccaccgtcttatcctggttcaccatcttcttataaatgctgaagaaatgcttcacacgtccgttcacttctgcatcaatgttcgcattcttcatatgcgtggaaacctcatccacgatctgctggacaaattcttccctttccgtttttcttgcattgatctgctttaccagatcgttaaaaacctccggctgggaatatttgagcgccagatcatcaagctctgtcttgatcttggaaataccaagccgttgtgcgatcggagcatagatatccatggtttcttttgctttttccaactgcttctccggtcgcatatactgcagggtacgcatattgtgcagacggtcggcaagcttgatgatgataacacggatatcttttgccatcgcaaggaacatcttacgaagattctcagcctggacctccagcttatccgctgaataggaaagctgtcccagctttgtgacaccgtctaccagaagagccacctcatctccgaattcctgacggatttcttcgtccgtcatcaccgtgtcttctaccacatcatgaaggatgccggcaacgatcgtctctttgtccatctccagttgtgccagaatgattcctacccacagaggatggataatatactcttctccggatttccgtgtctgccctttgtgcgcatctcttgcaatgtgatatgctttttcgatcatagagacgtccgccgaaggatggtactttctgactcgctcgatcagacttttatagagcagttccggattctgataatcttccacatcctttaccgcatgaccatctacgatctccagttttttatgtgttggttcgatcagcatctcctgctggattccgatatcgtctgccatagccttcccttctttctcattagtttcccggatactggattacggaatctactttgtatcctttcagtttttcccgtccttttaatcccatcagttcgatcaggcagagaacttctacaacctcaccgccaagtccttcgatcagtttgatcattgcttctgccgtaccgcctgttgccatcaggtcatctacgatcacaaccttgtctcccggtttgatcgaacgcttgtggatctcgatctctgcacttccatattccaaatcatacttgatcgatgctgtctcgcaaggaagctttccttttttacgaatcggcacaaatgctttttgcagattatatgcaatcggcattccaaaaataaatcctctggactccggtccgatcacgatgttgaaatccatgccttcaagcttatcctgcagttcccgaatggaaagctgaagcccttccggatcttcaagaatgctggttacatctctgaaaataattcctttttccggataatccggaatgctgacaacatattcttcaagttttttcatctttcttctccaccttacctacaaatatatgcaatatctattagtatagcataaaattgctgtttttcaaattatttataattttggatcacaatctgtggcgtacggactccctgatactcattgatatcaggataataggtaaatgccataacaattccatgcccatgtccgcgcagcagacactcacaggcaatatctccaaatttttcacgcacatattccacaaaggtattcacatctccaaaatacatggcatccatccttgtaccgtgaagatccttcacctgcaacttcagcacatttttattcttgccaaggattctcgcactttccacctgtacctgtctttctgcaaagaccggacgtgcatttcctttgccaaatggttccagaaccgcaagctcttcgacaaatttttcattgacacattcaaacgggagctgcatatctatggcaatcttttcattcagatcctctggtgtgatcccggatttttcgttaatctccttacggaactgttccagattctcctccggcatggagagacctgccgccatcttatgcccgccaaattttgacaacagatgctttacccggttcagtccttcatacatgtgccaggtctcgatcgatcttcctgagccctttaaaccttccgcgcccttcgtcagcacaaagaccggacggtaatatttttcccggatccttcctgccacgatcccggcaaggctttcatgacattccggcaggtagaccaccagcacgtctgcatccttaagttcactgttctccacctggataaacgcctcttctaccgcctgcgccgtcatatccttccggctgtcattgagtgctttcagatcacctgccagcagatccgcctccgccactttctttgcctccagaagctccagggcacgctttgctgtatccagtcttccactggcattcatacacggaccgatcacaaatccaatgtgatacggagacagcttatctacattcacaccagtacatcccatcagcgccttcagtcccagattctccgtccgtttcagcatatccagtccctgtttaacgaaaatacggttttcgtccaccagatccataacatcaccgatcgttgcgattgccacattttccatcagataatctgcatcttccgcatcttttcccatggcttccatcagagcctccaccagcttgtaagcaaccgcagccccgcacagccctttgaacggataagtacagtcctcctgcttcggatccacaaccgcatctgcctccggcagaatatatcttcgtcccgcaccaatttccgtatacgggacctcatgatgatccgtcaccacaatcgtcattcccatactttttgcataggcgatctcctctgccgccgcaatcccgttatcacaggtaacgatcgtatccacgtcggcctccagcgcccggtcgatcaggttccggttcagaccatacccgtccttcatacgatccggaatgtcactgtccacatcagctccgagcatccggaatccctccagaagaatataggtcgactggattccatcaatatcatagtctccgatgatcctgatttttgcattttcttttatcttttctccaagaaccgctactgccttgtccatatccttcatcagcattccatcgtacagatcggcgatcgtaccgtttaaatatttctcgatcgcatcatccccgatcacatcccggtttcttatcagggaagccactcgcggactgatatggaatttctcactgatatgctgaaaatccgctccttttctcagaagtacccagttctccattttctcttttcctttctttgatagtcagataatacaaagatgccggaggattctcctccgacacctcattttctgtcagttatttctttttcgctgcttttttgccgccgatttttgttttcattacataccataatgcaccggtgatacatacagatgaatatccgccacctgcaataccaaccataagaggtgctgcaaattctttaatagagcttacacccatgatataaagaaccgctaccatgacaaatgtagtaaatgttgtgtaaatacttcttgtcagtgtataagtgatacttctgtttacaagcgctttcagatcatcgtttctcttcatgacccgaagctcttcacggatacggtcgaaaataacgatcgtcgcattgatagaatatccaaggattgtcagcatacatgcgataaatgtattaccgacagatgttcttgcaagtgcatagaatgtaagcacaaataacaaatcgtgtaaaagagcaagaaccgcacttgatgcgaaacgtacatctttgaaccggaaccagatatagatcagcatacagatcgctgaaatgataactgcaatgatcgcatcctgtctcatctcggagcttaccgtagaactgatattttctgctgtaattgtcgatgtgtctacaccaaatttatcagcaagcgcattgttaagtgcttctctttcgtcaagattcagcgtctgtgtcttgatgatgatctgattgctgtcttttactttctgtgcctgtacattgtgatctccagtcacatcttctacaaccggaacgatctttgaatcaatctctttgatcgaataatctttatcaaatgttacggttgtagccgtaccgcccttgaattccaggctgtagttcagcgcaccttcaccttttcccgactggactcccattgttacaaaacctgctgcgatcacagcaattgatattgcaaagaaaatggctttctttccgagaaagtcgataacttttctttcttttttgaatttcttcgcataaaatttcacatcacgaagaccaatcgcatacagagagaaaatgatgatcctggtaataacaagtgccgtaaacattgacacaacaataccaagtgccagtgtctgtgcaaatccttttacagaacctgaacccttgaaccagagaatagctgcagcgatcagagttgttacgttaccgtcaacgatcgcagacattgctttgtggaaaccattcttcagggaagtcttaacactgatacctgttgtcacttcttcacgcacacgggcgaaaatgataacgttggcatccaccgccataccgattccaagaataatacctgcaatacccggaagggtaagcgtgatattgaatgcatttaaaagcaccaggatcagtcctgtatagatcagaagtgcaagacctgctgcaagtcccggaagcagatatacgaagcacataaatacgaagatgatggcaagtccgatggcaccagccattaagcttgtgctgattgcttcttctccgagctgtgcagctactacattagagcgaagttcttccagttccagagaaagtccaccgattcggatggtagctgcaagattgtctgcttcttcatagcttgacatccctgtgataacggcttctccgccttcgatcgcctgattaactcttggtgaactgattgtctgtccatcataaataatggaaatctgttttcctacatttgctgctgttgcttctgcaaatttggttgttccttctttggtaagctgcagggcaactacatattctttattcttagtcgtagagttttcctgcgtctgggcctctgcatttttaacatctgttccttcaagaacggtgttgccatctgcatcctgaaataccagtgatcctggtttgccgagttcttccagaactttattggcatcggatacacctgggatctcgatgttgatccggtcgtccccttcctgatatacacttgcttctgtactgtactgctctacacgcttctgtaacttgtagatcgtatccttcatatcttctgctgaaggattcttgtctttcgcctgataggtaatgctgacaccaccggcaaggtcaagaccaagattgatatttcttgcagaacctgtgtgggaggaaccaaatccctgccagcaggtaaatccaagaagtcctaaaagtgcagcaatcagaacaaggcttactattcctttactcttcttcatgtccaagtccctttcttagttttcgtctgccattgcagcctttatcataatcgcgcattctacgcgcttacgttccatctcacagcccagatcataagaatcatttaatccgtctgcatacttgtatgcgtttgccatacacccgccactgcagtagaatcttgcaaaacatttcttgcatttttctttggtatatacattgcagcaacggaactcatctgcgatctccggtcttgtaattccttcgtttacatttcccatcaggaaattttcatcacctacaaactgatgacacggatagaaatctccccatggtgtaacagcaaggtattctgttcccgaaccacatccggacagacgtttgtacagacaaggtcctccttccaggtcgatcataaagtggaagaaattgaatccttctccctttttgtctttctcaatgatatatcttgcaagcttgtcatactcatcaaagatctgcggaagatcttcttcacggattgcatacggatcagattcatccccgacaaccggttcgatcgacatctgcttgaagccaagctctgcaaaatgctttacatcctctgaaaaatccagattgtttctggtaaatgttccgcggatatagtagcgctcctgattacgtgaatcagcaagcttctggaacttcggtacgatcagatcatagcttccctttccatttctgaacggacgcattctgtcattgacttctttacgtccgtcaagactgatgactacattgtccatttctttattgataaactcctggatatcatcattcagaagtacaccattcgtagttacagtaaaacggaagtgcttgtcatgaagcttttcctgctctcttccgtatgccaccaggtctttgacaacctgccagttcatcagcggctccccgccaaagaaatcaacttccagatttcttcttgttccggaattggcaatcaggaaatccagggctttcttaccaacttcataagtcataagtgctcttcttccgtgatactctccttcttctgcaaaacagtatttgcaggcaagattgcagtcgtgtgcgatatgcaggcagagtgccttcacaaccgtcttacgcttgataacctccccgataaaaggttcatatgtatcaacaacaaaaagctgtccgtttgcagtcagctctgtcacatcatccaatatatctctaagttcttcttcggaatatttcccttccagctcatctttcagctggttccatgtactttcttctttcagcgtctgcactgtctgattctcgttcatacggttcagacatgcaataacttcgtaccccggctcgtccactacatgaacgcatccgctgttgacatcaagtacaatattatatccattgttctggtactgatgaatcacaaccggtacccctttctatccttatttttcaaatttttcctcatacgtcaaatgacagcggctttaaagccgctgcctgcttgtcatacttattcactacacttacaaatatctcttatttgctgtgttcgcaagtctgatttcctactgtacaagaagtcttgcatgctgactgacaggatgtctggcattctccgcatccgcccttctttactgtattgttcagagtctgtgtattcaatgttttaatgtgtttcattgtaatatcctccttctttgctcattatgtgatacagtatagcacattttccaacttaccgtcaacgcaaaaatccaatctaaaacaaatgacaggaggtattttccctagaatttgctgcctccgccaccgtgggttcttcctgatgaagaagtatgtgtactgctgccgccggaagagctcttcttttctttcgccgttttcgaagtcgtttcataaaggaacatatctctgctttctgtaatatccagactatcgtcttttacatagctgcctgccgctgactggaaacgcactgttttaagctgtgccttcatcctgccgacaatgataagtgacagaacaactcctaccccaagggagatcagaatccagattggggataatggctcctttggaagacttttcctgtcatacggctttccgtttcttgcctgtgtaatgaattcgtcacacagctctgaaaaagtctgaaatgccgaaaaataattttcatccttcagatcactcgtcatttcttttgaaatgtatttgatccctgcatcggtaaaagctgtgattccgtaaccacaggttgaaatataacagtcattctcttctcccagactaatgagaagaaggattccatccttatcctgtccatatccgaagtttccgtaatcataaatatcatcggcgtattcttgcaccgttttttcatccagcgtatttgttgtcacaacgacaacatccattttctgtcggatactcagttcatcaagtatgtcatttaattttgcttcctcactatccgtcataagtcccgccatgtcctgcacacgacaataatcatttgcaaatccttctgcatcttcggctgaaaccgaaaacgtcatccccaggcaaagggccagaacaagcagaagtgatattattttctttttcattccgtcaccccctaaaacagtccgagaaagtgcagaagtgttgctgcaccgtatgttaatgcagtgaacgcacctgccagtaccagtgtccaacgggttgctgccgccttatctaccggcaggtcgccgacgaattttccggtctgtccgttcattgcaaatgtatatttgttaccattccatgtggtatttaaaagccacaccggatataaagcatacttggcttttccgccatggaactgtacactggtattttcagctactacagtatcgtaaccaatgactgtttcggcaaatgcctgctccgtagattttttcacacgctcattcgcccggtcaatgctttcttctgcagtcacatcatacttatctgccaggtaaccggcaagataagccgtctggaaatccactgcctccctacagttaaacggttcgatggattccatcagatcatccgccatttttgtagagccatctaccggaacgtattcaaatccaacacttccgcctctgtgcaccatataataactggtctgggtataattgtaatcactgtcactccaagtacggatcttggttgccttataacggaccttagcgtctacatcggtatcaaatagccagaacggtacatagactcctttgatctcgtcaatatggttctgatccttaaaaatcttcggcagaagacgttttcctgtaagatgcttcatgagcccttcttttgctgcttttttatccagtttaaacggaatgaccagatccggtttcagggagccggagaattgtcccatcataacgattggattatcacagaatgggcaggatgttgccgctgtatttgcgtcacctacaatttctcctccacaggatttacacacataagtacgcagaccatccgtttctccttctccccattcaccgcctgctgcggtttcccattccatgctgtctgtttcttcgtcctgcagttcggcatcatatcccttcaatgcgtccatttcgaactctgtgtcgcaatacggacacttcatcttctggatcgtactgtcaaaggctatcgcaccgccacagcagggacatttatattcctgcaagcctgccataaaaatccccctctcttaatgcgcctgtcgatcaaattccgcaagttcttcgtccgctctccggatccactctgtacggtctccgtagattgcacatttgtttgccataattcatcctcctttcagccaataccggatttccggacattttcttttcttgtttatgattctcctgttgcttttacgacccatttggcattgtctacctggaagctgtaaccacagaaggaacaacaattgtgttcatccggtatgaaattggctccacaggatgggcaatctttttccttgaaaaatgctccgtccgtcttccttctttctggatatctcgccctctgcaaaacgagtgtcgtttttgttttctttgtatacggttttccactctcaggcaggtaggtttcacttccatatgccgtagcggtgatttctgttgttttgtctgtatttacaacatttttaagtatgatcgagccgattccataatccatcaggtccggcttatttacatccttatgaagtgcatcattgatgcaggacctcagataattttccgagtatcttacgatctcctttggcagcttttcctgtttttctttcttggattggaaaattttcgcaattcccagaagtataagcagtgtagcaattacacctatggtaagagaaatatccgtgtctttaatcagataaaggcacaatgtcagacacaggaacatgatgcccgagtaagcaagcaataacaatccatattgcatgttcgcacccattttctcataaatttcgaatacctctgtctgccagtcgtagaattcactttgtatcacaccgccacaatatggacagatgacttgctgactgctcagttccacctcagctccacaggatggacagatgatcgtccctttatcggaataaaattccttgttcttaccctgacggtcagaatgacggatatgccttgactgaagaatccgaaggtaactgtttttccgatagatctgatgcactgtcttaccagattgaggagaaataagacgttccaaagaactacattgcaggatagactccctccactcccgtccgtcatcattccatcttttgaaattattttttggaagtggtacaacgtccgtcacctggatatctcggcaaagcttacgctttcccagcagttccacctgatgaaccatctttctgcgaaatgtaagatccattctctttggaagataacccttatctgcttttccaagtggaagtaatacattttcaaaggaatccttgatgtccttctgaagccttgccccttgcaacggtgtttcacgctttgcaagaattcttttcatttttgcttttttcaaattctttggcataaactgttcaaagtctatgtcaatgattttctcagcaatggcaaacgcacagattatggtggctgcaaacgcaaacagcatcgcctctgacaatcccatatttatccctcctcatctatcattctatctggttgacctattgttcctcttgttccttctctttgctcttaccaaatatttcatagatcaggaatatggagataatgattcccgccgggatcatcataacggaggtaatgttatcacctatatcgcctgtgtaaagcttgtattctccattcaaagcccggtaagccttctctgtcacttcatccccccgggatatatctctggaaaatacatcttttcctgtataagtttttccatccacttcaaaggacagaattgcgtgatactttacatcttcatcgccattttcatcggtcttaacacttatctgataatcttttacaacggcggttacctgacgaacatcggaagatagtttatattctatactggaaaaaatatgagtaactccatatacaacgagcccaatcgaaccaatcagtaagaatacacatatcaccttattttgtgctttatctgaaagtaccttcacgcaactccctccttccatacttacagtcttctaccctctttttcttcccggtgatacttgataagatctttacttaatccaatgaaaccaatgagacctagcggaatcattgcagcaaatgcaaaaaagtaaatcggagttggtcccggttccaatttgtattttcctttagagttccggtaaacagtgatcagtacagtatcccctttcctgatttctttatagtaagtatcaaaatcatcatatgtcgttccatcgatttcataagtaaaccttactttatattcttcttttcggtctcccttatcatctttttctttcgtttgttcacaactgtaaacggttgcatgaagcgttcgaacatccgtggaattcttaaactcactgctttcatgcttcgtatatatcatgccgccgattcctgcgataataatgaagatacttaaaatcaaagcaccgattgtggtcttatgttcctctttttctgatgggagtctaaacatagaattccctcctctcccgcgaattactgtctgtcgttctcgtcaaagatgtcgccacattctgggcagaatttcggtgggtgtgtcgggtcttccggttcccatccacatttatcacaacggtaaagcggtgcgccttccggtttctttgctccacagttctggcagaattttcctttattcactgaaccgcaagaacaggtccatccttcttcctctaccggttttggtgatccgcattccggacagaacttaccggttgctgtggctccgcatttacatttccatgcacccggtgccggctgtggttccggtttcttgcttccgcattccggacagaacttgccggtaacaaagtttccgcagctgcacttccatccgtctgcctgcggtgccggctgctgaacggcctgttgtgcagcctgctgcgccgccatctgctgtgcctgctgctcctgctgttgctgacccattgcaaataaattctgtgcgttcataccgccgccctgattcattgccatgcccatgcccatgaagcctgtcattgcaccggcctgattaccggctgcagtcttcattgcatcagcctgtgctccgaccagcgttgctgctgccattgtaggatcgcgcatgatcgctgtacgctgagcctgttttataagttctgcatcttcatccggaagtgtcacagatccaagggcaatacttacaaccttcagtccgcgaagtgcgccccatttttctgagagtgccgtattcatcgcattttcaagatctgtattatgtgtcacgatctgattcggacgaagctccagttcagacaaatgtccgaatgccggctgaagagcagagataaactctgtcttaagagtagcatccagttcctctctggaatattcctgctccacatttccgcaaacattagagtagaacaaaagcggatcggcaatcttgtaagaatagacacctgaacagcggatcgatacgtcgatatcaagtccgatcttggaatccacaacacggaacggaaccggattcggcgttccgaagcgattttccagaatctccttggtattaaaataatagattctctgatcctttccggtatctcctccgtaagtaaaacgttttcctacagttttaaaggtttctttgatactctctccaaggctgcctgcaaaaatagacggttcggaagaagtatcataagtaaattctcccggttctgcacagacttctacgatcttgccctgttctacgatgatcatacactgtccgtctgctacagcaattccagagccgttcgagataatattgtcatttcctttggtgttcgctgaacgtccggtgacacgtttttgtccttttgtaacgagtacctcctttggcatcgattcacagtagaaaaattccttccattgatctgcaaaagtacctccaagagcacccatacctgctttaataagtcccataatattttctcctttcctttttgaaatgatcttcctctatgttatccggttacaccggaagaacacggtttaatatgcggcattccatgtgtctgtaaaaacatcataaatataaatgagattatcacaaacgccgtaaagctgttcctgcacaaactgttctccattatcagttcctaatacaaaaagcatacagctgcctccgtttatgatctctgattctcctgtatacataagcttcattccattttccagtccctgtctgacctctccatactccagcaggatctctgttgcgatttcaactgaacgttcatccggtgtttcctcatagactgagaaatcatatactccggcaagttccgccagatggccgtccattaatgaaatcgacggatggaaatctatggcatcgccgccatctgtcaccgaaaccagtacattggaatagatctcactgaaattacaacgcagtaccagcacctctcccggttttccttcaaataacggatgactcttatcatctgcatattcaccattttccgtgatatcagaaggatagacggtcactctgcctttttcatttggcggaacgatggcatacagctcctgcccatccgccatgtaacaggctgcttctgacaaaaacggatactcttttgttaaatgatgaaattccaggtaaaatgaaagatctgtccttgtaaattcactgtccacatacccgaaaagtgcaacccctgcaccgcagctgttttgattgatctgttttttgagaagtgacagttccgtatcttccgtctcgacgatttctgtcttccccggctcttctttttccttctctttttcttccttcttctcttcttttttatcatcctgcactttcacaagaccgcttttattctcgccttccacaggcttttgcggactgctcttatgaggcagtctgcatccgcataataagccggcctgcaggattatcaaacaaaacagtaatgatattttcttcatattacatttctccttgtaaagactgaaccttttttctttctccaaaacggcaagaatcattgtagtccagataaccatcaggctgtcgttaccggtcttaggagatttcattttatcgtccggagccttcttctgtaccggagctactgctttcttcgcattataactgtttgtgaaaacagcttcccgtacttcatttttcttctttatttcagtcggatatatacgcagtttcttctcggtggttcttccatttccttacatcgcataaatctgatccatcagatattcagcagtcatggatccatagaagaactggtcgataagaccgtttttcttcgcatcccgaatgtcttttgccgcctgtttttctgtattggaatccacgatgaaagcaattttacagtcaggacacaccctctttacttcatcccgaagcttcattctctcgcaaagcttccacggagtatagcccgtcacctccatgataagaacaaacggtttataaagtttacaaagttcaaccgtatcttttggagactccgtacggactacatcaatctcataatccgattttttgaaggcagtcgctacggaatccgcaaacagaaaattctgcatatcaaccactatttttcgcatcgaaccatcctcctttctttcagcgatatatccgatgtgtctgctacatttctttttttctttagtctaacagagaaaaatagctctgtctgtcctcataaatgtggacaaataagcattttacacaaaaaaatcgctctacctaataaaaagtagagcaattttcacatctaaatcctattttattttcttcttatacgtcgagctgactgctcggtacgaccaggcgtttgcttaccgccgcaaccatcaggcgattgcggtttgtgtatcctgttttctctaacatccggttgatataggtacgaaccgatgattctgccacatgaagcttagccgcaatctcggcattcgtcttcccttcacacaacaaacgtaaggtttccatttcctgatcggaaaggtcacaggaaagtgcttttccaagctgcacagccggcaccttgtccggccagaaatttttacctgcaagtgtcccttcgatcacgctaataagatcaccggaaggagaatccttataccagaagctgtccgctcctattttccttgcacgatccagaaatcgtccttctaacatggaggtcaccattacgatcttgatccgtggatagtattttttgattgcttcagccgcatctaatccatccgaatcattttctgtacaaatatccatcaccaccaggtcaatatgcccctcaccacatctctgcaatgctgcatctgcccgggtcagggcagatgccatttcacattctgtgcttttttctatgcaagagcacaaatacttacgggcaagcatctgatcttcaacaattagtatttttttcactttcattcctccctaacgtgttaaatcttaggaatttctattaccagagcaaactccggaaaactctgtacaagcatccttccgccttccgtttcaatccggtgacgcagattggtaagtcctccaccttcccggatttctctttccggaggctgtccgttgttatagatcatcacggtatagccggtttcattttcaaaaacatttgcctccagttctgtcgctctcgcatattgaagggcattattcagacatacctgcatagcagcatacatcatctctgctgcttttcccggtggttcctttccttctatctgcacaaggacaccactgcttcttgcactggcaaacaatttctctttttctgataaatgttcgacctcacgaaaaacaatattcttctcccattcccgcagaactgtttccacatcgatcccgccgaaatctccggaaagatactgcttcattacaataatactggctgcaagattatcatgcatagcagattttgccgtcaaaagttctttctctcgggcaatcttctccacattttcagataacctttgcagatgttcttcatcctcggcaagcttcttattttccacaaaaagcagtccgagcacatggcacaattccgtaacatccgcagctgtaagctggatataggtttctccatatcgatccgttacttctgttttctcaaactgccatatggtattatccggaaaacgataggtaccctccatattcgaaagctgcagaattccttccgggggggcgcaagtgcccgctcaacttcaccgagatactgcatatcactttcaaataaataatgactcagacgatacatctgcctgttgcaaagaacaatacttcctctgctgtcaaaaaagcagatcgccgtaggaagctggtcaaatccttccttgatacgattaaacccaaagcgcctcaacctacgcattatcctctcctcctattgctgtacgtatcagccacaatccatcctccttgtcgaccgttacctcagaagagataattggggacaaatcagccgcacattctacagacagattcatctcctgatcggacacagaaataaacagcgaatgcagctcatttatcgtcatttccgttaccgtttttagcagttcgaacaaacgcacaacctcttttgatgctatcggttttgtggttaaatagaccgcaccacattcaattttgcaggaattcattgcacgtaccagttcatcgatcgtcagcctgagttcctgctgtggaagcttttcgtattcctgagaaagaaaatacagattcgcacttcgcttgatataagtaccgagcaacagaatctctttcatacacgcctgcattacctccggctttgcattcttacactgttcaagaagttcctttatcctcctcgtctgggttttgtgtttttcttccagttcatcataaatacggttcttttccgttagttcgtatagctccttctgcacaagataagcatcctttaatttctttttgttattctctctttttcttttattctcatcaagctgcttgcgaagcttggtaaggtgctgcaagttatctccccagatgacaaaaccatctttaatcggtgccgaagagatgcgcattccatccggataaacgatactctccccatcttttggacataccatatcctctcctgctgtgcgggaacgaagcaaaatccgcccattttgatctgcaatgcaagaggcaagcgttgtcgcctcatataactcgacataccctgtgtttgactgtatcatacggcaatggatacagctttcgtatattgcagcataaaagagacaaaacattacattcatatctccaaaaacatcacggatgacctgaaatcccaaaagataaagtgctccatacaagagcatcacgcagctcaaaacaaaaggcatcattctccgctttccaatacttggaagccttgtttttttcagcagctgaaatactgaaaaaaatacacagcctatcatccatccaacactcacaaaataaagcggacgatgaaaaaagactttgttatccggcaccccaggaattccgctcgcaaacgaaaatacttgctggtggaaatcatttgtgataacagccagaaacaatgctgtcggaatcagcgataacaaccagctttttctggaaagctgataatcttcggattttcccagaaaaattgcagtatatgcaccaagcagcggaataaaaagaatcggcaggtaataaagataccacaaataacgtgccacggtcagatctgtaaccacctcatatttcaaagtacgcaaagtcaaccagataagcatcagaacatccatcaagcgaagacagtgcagcaccggtttctgaataatccgctgatccagagaatacccccacaagacaaataataataaatacaatgcggcacacacatagcttggatagtttcctcctatatcaaaccatgccagcagccggcaggaatatgctgctatgattatcgcaaaaacaaaaaacatcaaataaagctgtctggtgttccttttcacgagttcctccctctcgcccggctcatcacctccgggcatttttatcacctatagtatagtataagcttccttttggcgcaactgcttcccccggattaaaaaataaaagtatcgcccatatcccttgataccgtcaacgcaaaaattacatctccgccccttcaggacaccataccaccgagcattccgcctgctccacagaggatccaggcgatcatcatctgcattccaccctgcacgctccggtagatccctgctgaaattgcaagcagtagcagaaaatagagcattccaagcataaatcccctcaggaatttccttgtcttccccatttttcccatggcaaatccaccggcaaatgtggaaattatgtaaaccgcaaggatcccgatccggactgttttctcgcttaagtcaaacttatacagcccaaaggacagcccgagcagcatcagcatcgtaagaaagtaagaaagcatcagtgctttcacaagtcttgtaaaacagatatttccaaacagctttttttccataagaacccctcctgtccttttatactatgagagattcttatgaaatattcctttactgttccatctgtcgtcccagaaatcctgctgcgcagagtatcatcttctgttccaactcaccgggttttttcctgccatcctttgccaggatcacgacagaaccgatcgcatctccggcgcagatgatcggacttaccacctgccatttcagttctgcattctgtcccgacacgatgaccgtgaacttccgatccatagaagatgccagaaactgctcccttcttgcgatcacttccgcaagctgtcttgtgatcagctgttcctgaaattctttcttccccggtcctgctgctgcgatcacctgatctgtatctgtgatacacaccagatatccaagtgtctgtgccagactttccgcatattggtctgcaaaatttcccatttccccaagcggtgagtattttttgagaatgatttctccttcccggtcggtgaaaatttcaagtgcatcaccctcacggatacgtagcgtgcgcctgatttccttcggaacgacaattctgccaagatcatcgatccggcggacaattcctgtagctttcatattgattctattcctcctgtgttccacatattttccatattttattcgatatgggtagtatgtggaaatacaacatttttattcctacagggttttttttacctgaaattttatgatgtaagtgtcaaaagtatcaattgtgtttgtgctcgcacaaataagcaattgatacttttgacactcatatcattttattttttaacagtaagaatttcacattatatataaaaatccctcatctgcggtttcccgcaaatgaaggatttcttttactttattcaatttttacagtaatccaccgattgataagaataacggtgcaaatacaagtgaaacaattgtcataagtttgatcaggatgttgatagacggtcctgatgtatccttgaacggatcacctactgtatcaccaacaactgctgctttatgagcttcgcttccttttccgccatgatgtcctgtttcaatgtatttcttagcattatcccatgctccaccagcgttggacatgaagattgccataagtacacctgtaacaagtgctccggaaagtaatccaccgagggattccacaccaagaacgataccaacgatcaacggtactacgactgccatcacacccggaagcagcatttcgtgaagagctgctgtggtagagattgcaacgcatgacgtataatccggtttttcttcacctttcataatgcccggtttttcacggaactggcgtcttacttcttcgatcatcttgtatgcagcctttgatacagactccatagtaaatgctgagaagaggaatgtaagcataccaccgataaagataccgatgattactctgtagtcaagaagattgatcgcttcaagaccaactgcctgtgcataagatacgaaaagtgcaagtgcggtaagggctgctgatccgatcgcgaatcccttccccatagctgcagttgtatttcctactgagtcaagcttatctgtgatttcacgaacagattcatccaatcctgacatttctgcgataccacctgcattgtctgcgatcggtccgtatgcatcaacggcaactgtgatacctgttgtagaaagcatacctactgctgcaagtgcgattccgtaaagtcctgcaactgagtaagatacaaagatacctacacagatcaggagaagcgggattgctgtagatttcattcctaccgcaataccactgatgattgtagtagctgcaccagtctctgactgttctccgattccctgaaccggtttgtagtctgctgatgtgtagtactctgtgatgttaccgatgatcacaccaacaaccagacctgcgataacggcaattgccgcactcatctttccgaagagtacattactcagtacaagtgctacaacaataactacgatagaagctgcatagcttccctttgtgagagctttctgtggattcgaattctcatcaccttttacaaagaaggttccgatgatagaagcaatcagaccacatcctgcgatcgcaagcggataaagaactccggatacagctcctgctgctgctccaagagtcagtgctgatacaagtgaaccaacataagattcaaaaaggtctgctcccatacctgcaacgtcacctacgttatcacctacattgtcagcgataacagccgggttacgcggatcatcttccgggatacctgcttctactttaccaacaaggtctgcaccaacgtctgctgctttggtgtagataccaccaccaacacgggcgaaaagtgcgattgaagatgcaccaaggctgaatcctgaaagcacatctacgttctttgtaacaatgtacacaaggcttacgccaagtgctccaagacctgctacgcacattcccataacggccccgccagaaaaagcaattgataatgctttattcattccgctttcttttgctgcgttagcagttcttacgttcgcttttgtagcgactgtcataccacagtatcctgcaactgttgagaaaagtgctccaattacaaagcatactgctgttacccagctgataccaaatccgatcagtacaaaaagcactactacaaaaatgaccagaatcttgtattcagccatgaggaaagctcttgcgccctccgcgattgcgcctgcaatctctttcatgcggtccgtacctgcatcctgttttcctactttaccagcaagatatgctgcaaataataaagcaataacagctgcaatcgggaccagatacatgtaattattcatttcttgttcctccctgaattattgtacctctaaagacaatatcataaaaagaacaagaatgcaaaacaattttttgaattttcaataagttttattttgtttatctataaatgtggtctttctctatttttttaatttgtatctcaccgtccacattccactgggatttacacaatatcaagatatgtttttttccgaggtgccggaaaagtagcatctaatctggcatattcctccactgtcaaatgaacctttcccgcctccaagttctgcagtacatgttctgcctttccacttcttggaatggcaatcacatccattactcagttttatctcctttttatccatgatttccactccctgcattttgtttttctgttccttactgtctgtttttactatcttatgatatgagtgtcaaaagtaaatttttccactcactgatgtaaccggattgctccattgctatgcaattcccgcaatcctcgaacacctcatattatatgaaatgtcccactttttgcaaatgttataaggaacatatttttatgtttatttattctttttattatttcttataacattctttttttcttcaatccatgatacactggatttatcataaaatgaattcaatgataaggagattagaaattatgaaagttgtagttgcaattgattcatttaaaggaagtctcacttcgattgaagccggaatggctgcaaaggaaggaatcttaaaggcacacccggatgcgaatgttgtcgtaaaaccacttgcagatggtggtgaaggcaccacagatgccctgattgcaggacttggtggtgagcgtattgatcttacagtgactggtcctcttggtactccggtaaatgcacattacggatatctggcagaaaaaaatactgccatcctcgaaatggctgccgctgccggaattatcctggtaagagaatctgaaaaaaatccacttactgcaaccacttacggtgtcggtgaaatgatcgcagatgccatggaacgcggtatccgcaatttcattattggaattggaggaagcgcaacaaatgatggtggaattggaatgcttaaggcacttggctatcaattttccgatgaaaatggacaggatgtcggcgaaggcggacaggcgcttgaacgggtatcttctattataatagaaaaagctaacccaattctcaaagaatgcaattttcatattgcctgtgatgtagctaatccactttgcggaaagaacggagctacctatatttatggtccgcaaaaaggtgtcacaccggaaatagcagcagaactggatcaggcaatgaatcattatgcttctgttacctccaaatttcttcataatgattatgcatctgcagaaggtgctggtgctgcaggtggtcttggctttgcatttctcagttatttaaatgctacgctgactcctggaatcgatctgattcttaacgctgtcgaactggaaaaagaattagaagatacagatatcactgttaccggcgagggacgcctcgatcaccagaccgttatgggaaaagctcctgtcggtgtggcaagacttgcaaaaaaatacggctccaaagtcgttgcttttgccggaagcgtcaccccggaagcaacagcctgcaatgcagccggaatcgatgcattcttcccgatcgtccgtggaatcacaacactagccgaagcaatggatccccaaaatgcaaaatcaaatatggcagcagctgtggaacaggtattccgtctattatagttttaacattatttataaatttcagagagtgtttttgtatagtttttacataaatactctcttttctttatgattttcttcttttcctacactgatcatctgtgtggtcgcagccatgtttatcggactaaccgtccttgcctgtggaaaaacaaccggcacagatctgtccagtcagccaaaaacacttaccatcaacaacacaacgatctacgacctgacagatcttcatttcatctgtaacaatgattcttcatcaaatgaaaagctgtcacttgtgaagaccggttcttctgttaccatttctctggatgactctgcaaacctctcagtgatcgcaaatattgcagattaagttttgccgtaaacaatccgcctatgtagttttaagcaatgacaaatatgcaggcaacttccataacgcaaattgcctacatattatccataaagggacactttccaaactgaattgcaagtgcccattcttctttctttttatcgattgccagtcccagcatcattctagttgattcgctcatatttggttacatctttactaatctttcctctactcgtccattatgtcagcgcgctgtcatttatctgacaatgctattgtacgaaaaaaagacacaaattctattgacgctttcatcaatacctatgtactttttttatgtattctttacaattcttccccttgtacctttccaccttgttcctctctccaaataatgctacaattcttaaataagtggtaatgataccgttctctttatcctgttaaatgcaggataagcatctgcatcattcccgcaacttcttttccagaatcggaggatgtttaaaatgaagttagacaaatcacttgcctttcaggtagtaaacacgatcaaagacacctgcggacaggatatcaattttatcgataagcagggaatgatttttgcgagtaccaacgccgaccggattggtacgtttcatgccatcggtcacaaagccgcccagacagaacagacaatcgaagttttttcagatgatgattttcccggaacacaaaaagggatcaatatgccactctattatcacggcagttttcttgcagtgatcggaattaccggagaaccggaccaggtccgccagtacgtccatcttgccgaccggattacccatctgctgatccgtgaaaaagagctgaaccgactgagccgctctctggaagataaaaaacactttgttatcgatgccctgatccggaatgagattgctgatccggattatatggacacctgcctttcagatcttcaggtaaatccagggacaaagaaacggcttctgatcatccagtcatcaccggatggacacaacaactcttcttcccttgagcagaagatcatcggacttttcggcacgcttggtattactctttataccttttattatccaaatgaatatcttgccgtgctggaaaactccggcaaagccgctctctatcagatactggctgattttaccgcaaactgtggagctttgctctccattgcagtcggaaagaaatgtcagcttttccagctttctctttcttaccagtctgcactcactgcgctgaaatactgccggagttcggaaaacgggattgcttttttcgatgatatgacactggaaattctgctctcttccatctcggagcaggaaaaaaatgcttatctacaaaaaacaatctctgcactttctgatgaagaaaaaaatctgcttcagacttactttgaagcaaatatgtctcttctcggaaccagccagaagctgtttcttcacaaaaacacagtgcagtacaagctgaatcatatttatcagaaatgcaggctgaatccgcgtgttttcaaggatgcggtgcttttatatcttgccttgcagttgtgatatttttaaatcccagacacggattcctgtgcacacatcttccatatccgtgtacaggtttgtccatataagaaaatattcttaacaaataagtttacttacagattttcgtcaaaaaacaggacagcctttccttcaccctcacaacgggtattaaaaagcagccaaagaattcatctccctggctgccgattatttcaattgtatttaacaatatgccttttttgcttcgtccattctctggaaaaattcactgtaaaattcttccgtctgatacggagtaaggtaaaatctctgcagtacatccatgctgaccgccttcgcactctccgggtgtgctgcaatgtattcctgtaactgaatcagtaatccatgccatctggcaatatacgcttcatactttttcagttccggtgtatcaagccattttttgacctttactttcgcccggttctctttctgacattcatgtacctgaagaaaatagcggaaaccattttcctcataatatcttccaagcgggaaaagcctgcagattcccggacgaaatggatgaatcccacatcttccttcctcagtcagaaaaccacagccatcttccgctcctgccatcttcagattcggcaaaatgattccgtctaccacattcagttcaatctttcctgcaagcaaagtctcaaaagccgctcctgttcccctgctgatccggacaatatccagcggatccagcacgattgagcttcccatccccgtacaacaggcgtggcatccctcacaatcgccacagtctgcttttaccagatcattgctggtatataattttccatctgaaatttcttccattgtcacctgtcttttcatatcaatctcctttcctatactccttccagtgtaaacggtggaataaagctctcctttgccgtatccccttcctgtataaacgcctgcatcacaccaagcgagatcgcatagtccaccagtttctcatacgcatactccggcactttccggttcagctccggatattttaccgcatccagactctccagtggcgtatactggctcatcaggctcatataaatccggtttccataagtttcatgcaaatatttcaccactctttttccatccgcaagacatcccggcaaaagcagatgacgcacgatcacgccacgtttcatcattccgcgctcatcaaataccggcttcccttcctgtcttaccatctcagcaagagccaccttcgcaacctccggataatcctccgccatcgaatattttttcgcatgatctgtatttaaatatttgaaatccggcaggtaaatgtccaccagaccatccagcattttcaaggtttccactctctcgtaaccgcccgtattatatacaaccggcaaatacatcccctgcttctttgcactctgaagcgcccggatgatctgcggcacaaaatgcgtcggcgtcacaagattgatattattcgcacctttcccctgcagttccagaaagatctccgccagccgctcttctgagatcactttgccaaccttgcttcccgcaatctcatggttctgacagaacacacatcttaaagtacatcccgtaaaaaagaccgtccctgatccttcctttccggaaatacaaggttcctcccacatatgaagcgccgctctcgccgcccggatctcccctgtctctccgcaaaaacctgtcttcccattctccctgtccgccccacacatccgcggacataatgtacagccactcatcctatcgcttaacctctcatctatccctgattcattcctatcagtataccgcactttttgataaatagccacccaagttttcctcttccagagattgaaaattcttttcccatctgctacaataaagtgcagacaggcattttgcctcaagtttggaggaatatacaatgagtaaaattgatgaagtaagaagcgctatggtcgcagccatgaaagcaaaggataaggacacaaaagagacattatctgctcttcttgcagcccttaagaacaaagccatcgacaaacgtgccgatcttaccgaagaagaagaagttcaagttatcttaaaagagatcaaacagacaaaagaaactctggagatgactcctgctgatcgtacagacattattgaagaatgcgagaaacgtatcgctgttcttgaacagtatgctccgaagatgatggacgaagctgagatcaaagaagtgatcgcaggtgtcctttccggtcttggaattgatgctccgacaccaaaggataaaggacgtatcatgaaagaactgatgccgaaagtaaaaggaaaagctgacggaaagcttgtgaatgatattctcacaggaatgatggcttaatagcagatattatgaatgcagggttccggattggttccctgcatttatatatagtcgaatatactctgtattgcgtctgttacattaattacatctgccatttttacacgatctattattttataccccctgactctcaagtctaacattttcatttgttcacattggatataacctttattttcatccatttcaacataaatgtgaagtgggctttctgtactctctcctaatattggacagccaattatttctcccgactgattaaaaaaatttttacttgcaacaaatacaggatccttaattttttccacttttaaaacatccccctgctgtatctccattttctaccacacctctcttccttctggcttatcccattcatattctccatcaagatttaacttaccaccaaacttttcagctctttcttctaatttttgatgcctgaaggtcttaacaagcataatcataccatccgatacttttacttccagcatatcatttatttctacattggcctcttgtaaaatatcttttggaagtctgattccctgactatttccccatgcttttacctgtgtttgcataaaattcacctccatataatgtatatacttagtatatacattattctgaaaataatcaaatatttttctctcctaatcacactcttcctcaaaatatgttataattcataagcatcagtcttttacaaaatcataattaccaaaaggggatttacttactatgaataaaaaagaagttactgaaatcaaaaaacagttcaccccatccaactgtgcgatcacccgcatctgcggatgctatgtagatgatgaaaaagagaaaaaaacggagatgaaagatgctttcctttctcttccggaagaggaaatgttcaagtattttgacatttttagaaagtccttgtccggtacgatcggaaaaaatcttctgaatatggaatttcctctggagaccgaatcggaaggtggtacacaggaatttcttctcaaattaagaaacagccggcttactgacgacgctcttctggaagaattctataatcgtgtcatcgattcctatgattatgcagagaactatctgatcctgctggtccatgcagcctacgatattccgggaaaatcaacggacggaagtgaaatgttcgatgcatccgatgaagtctatgattacatcatgtgtaccttctgtccggtcaaactttccaagccaggactcagttatcatgcagaagaaaacagtttccatgagcgtatccgtgactggatcgtagagatgccggatgccggtttcctcttccctgcttttaatgaccgcagcaccgatattcacaatctactttattattcaaaaaatgcagagaatctcggaaacggtctgaccgatctgcttcttggatgtgttccgccactcaccgccggaaatcagaaggatactttccgtacactgatcgaagaaacgctcggtgatgactgcgactacgatacagtcaaaaatatccacgaaaacttaaatgaaatgattgaacagaattctgaaaatccggaaccacttgcccttgacaaagcagaagttaaatacctccttgccaaaagcggtgtcgaagaagaaaagttggaaacattcgatgagcagtacgattccgctgccggagagcacggtacactccttgcctccaatattgcaaacctcaaaaaattcgagatcaaaactccggacatcaccatccaggtaaacccggaatgcgcagatcttgtagaaacacgtattattgatggtcagaaatgcctggttattgtcgttgacgaccgcgttgagatcaacggaatcagtgcaaagactgccgtatccggaggacttccaaagtcttctacccctgatgcatctgatgaatccaaaagcgatacatccgaaaatgaaatggatgttccattctaaatgccttacatattattacaaaagacatttttattgattatctttcgtaatatttccttatttcttttcaattttacaatgtatacgcaaaatgcaggtaatcctctcgactacctgcattattctatacgcaattttctattttcacttacaccgtttcccggctctttttcacctttctcttaaatcaccgttcctccaccggtcgtcacaaatccaactctcagaattgctttcacaaaactccacattccattgattactgcagaattcagcagactgatcggcacatccagaattcctgttccaagtaacagaagcagaatccacatactatacggtcggatcttccagtaaaactctgctaccctcggaaagatctcagcaagaatattcgatccgtcaaggggcggaatcggaatcagattgaacacaccaagtccaatattcagcactgctccataataagtaagcacataaagataattcaaaatcaacccactcgatccgtacttatacaaaagcccgtgcagaatcatacatacaaacgcaagcaggaaattcatgactactcccgctgctgccacaaggatcgtatctctttttttattcttataattcctggtattgatccttaccggcttcgcccatcccacatgaaatacaagcagacataacgttccccacacatccagatgcttaaatggattcaaggtcagtcttccgtcatattttggtgtcatatccccgagtttatatgacacatatccatgtgcaaattcatgcagcgaaacagcaagtagtgtagcaggcgcaacgtagattaaagtctggaaaaactgatacattgccctggtcagtcctatattctgaaacagcataacatcctccaaatttccttaataacgtccattatagtacctgatgaaatgggattcaagaaagattgtgtaaattttttctaaagatctacacgaaatgtaaccgacagactgatgaagacttgttatatgcttcaattgcttttcccctccaaaaataaaaggcagccccacttgactgccttttgtttattcctgaataactcagattatttaccttctttttcgtattctgtaattcttgccacctttggcatagaacgggattccggatcgaaagttacgcttaagtactcttttacgaggcattttgcgagctcaattcctgtaacctgtgcaccaagtgtgataatgttggcattattactgagctgtgctctctgagcctgatatacattgttaaccagtgctgcataagctcccggaactttgttggcagcaatgcttaccccgatacctgttccgcagatcaggattcctcttgcaattttcattttttcttttttattttcgattattcttgtgttttgttttcgttttctttcgttttcgccggttttctctttatctgcaactgcaggttcaccccaaacggattgactgcaacgccaaatgcttccggtgaaagaatttccggaatcttacttccttctacaacagcggttttcaatgttacacccttgttcaggttctggaatttcttaacttcctgcacatccgtaaagattggctgatacacttttccatctttctgtttcaaaatcggaattcctttgtcctcctgaacagtcacaatataacgcccctcctgataatgggcaagcatttcttcgttcagttcttttaactcatccgtcatctccggtttatccggctttctcatctgttgcataaaatacgctgcagtcagcaccagttccggattctctacacgtatttttccttctggcagttcttcatccttcggtctcgtgatcaattcgtcaagctgcacagtaatctgtccgtccaaccctttgtccaccagaatacagttgactcccattggaaacaacccggtaaaaaatgacaggcgggaattttcatccaccttgacaagctgcattggatttccctccttctgaagcttcatagcctcttctttcgcttccgcttctgtgtaataaagaaggatctcatcatcaaatgtctccggatcgcagaccacatatggcattcttgtacaggatgacatcagtacataaattgcctctacagtacgcagtttatttaaagtttcgattttctgatttgtattactcattctagtatatccctttcctatttctccatataacaagaattatacccgtctgtccgaaagaagtcaatttatactcccttattccacttgattatcttcgtattttcctatatcatatgtgtttagtggctgtttttacaatatttttactcttttaccagaacagaaaggaatgagaaaatgaatcaagaaaatacatctgcacccgcagaaaacaaaatgggtaccatgcccatcggaaaactattatttaatatgtctctgcctatgatgatttctatgctggtacaggctttgtacaacatcgtagacagtatttttgtcgctaaattatcggaaaatgcactgaccgccgtttcacttgcctttccactccagacactgcttattgcagttggaaccggaaccggtgtcggcatgaatgcactcctttccaaatcacttggagagaaaaatttcaaaaaagcaaatgcaactgcaagcaacgctgccgttttatattttttcagctatctcgtatttttcattcttggctttacgattgtccgtcctttttacgcaagtcagattggaaatgctgaccaggagatcatggaactcggaattgagtacttaagcaccgtcatgattttttctttcgggctgcttgcacaggtcttctttgagcgtcttcttacttcaaccggaagaaccatcttcagtatgacttcccagctgacaggggcaatcactaacatcattcttgatccaatcctgatcttcggacttctcggagctccgaaaatgggtgtgaccggagctgctgttgcaaccgtgatcggacaatgcgttgccgcacttgtcgccggattttgtaaccaccggtacaatcatgatgtgaaactgaagtttcatggattcagactcgatttccatattatcggcaccatttatgcagttggaattccaacgattattatgcagtccatcggatcggttatgacttactgcatgaaccgcatcctgatcgagttttcatcaaccgcaactgctgtattcggcgtttactttaagctacagagtttcttcttcatgccggtattcggtctcaacaatgggattactccgatcattgcctacaattatggtgccggtcagagaaaacgtatgctcaagacgatcaagctcagtatgctggttgccttctgcctcaccttcatcggattcctctgctttgaaggaatcccacagatacttttgggtatgttcaatgcatcggacgagatgctcaccatcggagttcctgccctgcggatcatcggaatccactatctgatcgcatggttctgtattgtatcaggaacagtatttcaggctcttggaaaagcatttttcagtatgatcgtctccattatgcgtcagttatttgtactgatccctgccgcatatatccttgcaaagcttggcggtcttcatgtagtgtggtggtcattcccgattgcggaggtcatttcacttatggtatcctccttcttcctggtacggatcaaccggacgatcatttccagggttccagagggaaaactttagtagaactgtgctcggatagttcctctgatagcgaaaaagaagattttcacgtgtcgattcagatccgcgaaaatcttctttttattttaactttatcttacataaatccctgtatggattcgtcctcgcaagcccaatctcaaccgcttcacctgtaaacggtgcaaactggttctgcatcacaacaaatgcctcccgcatttccgcctggttcagtctttttcccagtgttgtatgcgggaaccaggaaaacggctggtatctgatctggattcgtacctcctccagatatctgatctttgagaaaacagactctgacagcttttgcagatatgcatttaaaaccggtgacaaataaattgtatgtggcagaaacatccctaccgagcaccagaaaatctgtcctttttcaaattcctgttccattgccataaagccggcgattgctttctcttcttctgccatatcaaatgccgacaaggtaatatgtggcggaacctttccgtcaatcatcgccatattgcccgttctttgcgcaatctgttccatatataactggatcttcttgtttgtcccttcgtcaaaataaagcgatatgaggtacatgctatcctttcagtcccgctgactgccggatcatatcttccactacaatatcgtagatctcgccgatactgttacaatattccagaatcttccatggctcgtttgtatggaaatgaattttgatcaggtcttcatctcctaccgcgatcaggcagtttccctcaaaatgttcggatatatattctgcaatctcatcttcatccagatcttcatctcttctgtcgatcagaagctgcgtatcataacggtatgcaaactgatcctcttctacgtctatactgtgtacattttccatctgtttgttcctccttactcaaagttcaagaacagtatagcatatttttatttgttatcaaatgaaatatttctgaccatattccggttgatcagctgtattcccttttcccctgcatccacttttggaatccgtaaaggattaccggaaaattgacggacttatacttgaatgatttactttgtcgcagaattacggcagtgctccaatcttacgaacaagttcgttcgattgacgggcgtacgccttgaatggattacttttgtcgcaaatttatggcagtgcacaatctcacgaacatagttcgttcgattgacgggcgtacgccctataaataactcaagccgaggtcaaattcctgctagcaggatttgacctcggctttccttatttgcactgcctatttttgcacaatgtttatgatcttcttcggaacgtagatttcttttacgatatttcctgtaagtttatctgcgattgcttcttttccggcagcgattgcttcttcttttgtagcctctgcggaaatcttgatgactgctcttgtttttccattgatctgtaccggaatttcgatttcatcatctttcatggcttctgtatcgtattttggccatccggcacggaatacgctttctttgttgccaagttcttcccagatttcttctgccatatgtggtgcaaatggtgccagtaatacagcaagggtatccagagtatctctgtctactccgccttccttcttagcgatcgcaaccagtgtatttgtatgctccatgaatgcagaaataacggtattcaggctgaagctttccagacgggttgtgatatcataaaccagtttatgacgtactttgatcatctctttggttggtttaatatctttatccttgctgtccataagcaggttccagagtttcttaaggaaacggtatacaccatcgattcctctgtcatcccactctgcatccagttccggtggtcctacgaagagttcatacattcttaaagaatcgcatccataatctcttacaagatcatccggagacacgacatttccttttgacttactcatcttgataccattcttacctgtgatcattccctggttgaacagtttgacaaacggttcatcaaaatcgatcacaccgatatcgcaaaggaatttagtatagaatcttgaatacagaaggtgaagtactgcatgttctacaccaccgatatacatatctaccggaagcattgcatctgctttttctctggatacaagttcttcgttgttgtgattatctacataacgcaggaaataccatgaagatccagcccactgcggcatggtatttgtctcacgttttgccggttttccacaaacaggacaggttgtatttacccattcatcgattcccgcaagtggagattctcctgttcctgtcggttcataagattctacatccggcagtctcagcggaagctgatcctccggtaccggtacagcgccacattccggacagtgtacaatcggaattggttctccccagtatctctgacgggagaatacccagtcacgcagcttgtagtttacagttgcacgtccgattcctctttcttcgatgatatgtggagcttctttcttaaggacagagctttccatgccattccattctccggaattgatcatcgttccggaagcctctgtgtaagcttctgtcatattttcgatttctttaccgtcttttgcaataacctggatgatcgggatgttgaacttggttgcaaattcaaagtcacggtcgtcatgagccggtacacacatgatggctcctgtaccataatcagccagtacataatcagaaagccagatcggtacctttgctccgttcagagggttgatcgcgtaagttcctgtaaatacacctgttttttctttgtcctgcagacggtctacattagacttcatagaagaatcgaagatatatttttctacttcttctttgtgttccggtgttgcaagctctgctgcaagcttatgttccggtgcaagtaccatgaaggttgctccatgaagcgtatctggtcttgttgtgtatacagtgatcttatcttctcttccttcaaccgggaaatctacttctgcaccgtaagatttaccgatccagtctgtctgcatctttttaactttttccggccagtcaagcttatccaggtcatttaacagacggtctgcatattttgtgatacgcagcatccactgacgaaggttcttctttgtaacttcagcgccgcagcgttcgcattttccgcctacaacctcttcgtttgcaagacctgtcttacaagacgggcaccagttgatcgggaattctttttcgtatgcaagtccttctttgaacatctttacaaagatccactgtgtccatttgtagaaatcaggatctgttgtattgacttccatatcccagtcataaagcgctgagatctcattgatctgacgtttgatattcgcgatgtttgctgctgtcgattttgcaggatgggttcccatcttgatcgcatagttttcagccggaaggccgaatgcatcccatcccatcggatgaatgatgtaatatccctgaagcagtttgtaacggctccacacatcggagataacatagcctctccagtgtcctacatgaagaccgtttcctgacggatacgggaacatgtccagacaataatatttctttttcgggttgccgttttcatccactttcggattaaccggattctcagcccatttttctttccatttcttttcgattgccttatgattgtaaggtactgccatttttctttcctcctggtattgtttcagtatgaaaaaaagtgtcttaaccttttatttaacaggaaattccatcaggatttcctgttaaataaaaatctttcgcctcttttgataaattcaaagagacgaaagattaaattccgtggtaccactcttcttcgccgcatcccggtaacataacttacggtgcagcgcacttgtgattctataacgggaattcccgcttctgcctatctgaaaaccgttcagcagaagaactcaaaggcgagttcaaagatttgatctgctgccttgcaccgcccggcagttctctgtacagactctaatcttttactgatccttatccttgtttttttcatataccttgttattataaaaataaatacaagttccgtcaagagattcttgattgttttttacgaattcttgattatttttaccatttaaaattgatttccgttatctctcagccattttctatattttttatagtccggcatccacgtcgccacgaccttccagaatgcagcggaatgattcatttctctacgatgtgccagctcatgcaccacaacataatccagaactcccggcggcatcagcaccagcttccagttgtaattgagattccccacgctgctgcagcttccccacctggtcttctgctcccggatggaaatacgcccataggtcacacccattttccgggcatagtatccggtccttgcacctaatacttctcttgcaagattccggtaatatttcttttctgcttccggcatctctctcttttcctgccgcttcattgcattttccttctgaagctttaccttctgtcggatccagttctctttctccagaagaaaccggtcaatccgctttttctcacaggaatagggtgcacggaccgtcacctttccttcccggtcaacttcgattccaatactgcgcctatctgaccggatcagatgatattctatgtccacgaccggatcacctccagaaagcgctctccatatttttcaaacttgaactctcccacaccggaaactttcagcatagcattcttatttatcggtttttcgatacacatctgcacaagggtcttatcggaaaatacaatatagggcggaactttttcttctcttgctatctctgcccgcagaacgcgcaggatttcaaaagactcttcctgctctttattcagaaccagtccggccgttttcttcacttttttcttcgctgttgtcttcgcctctttctccggttcttttgccatcttcattgtaaatgtctcctgccctgcaatcagtgcttccgacttttcagtcagtttcacaatcatataagaatccggcgtggtcttcagatatccttctgccagaagctggttgaatatctgcctgagcttccacgatggcgtcttagaaagtaccccgtaagccggactggcacccatgccatactgccggatcttcgcattgtttgccccatgcaccgtatccagaatcacattgattccataacgctgatgactttcttttacacacatggcaagtatccttgcctctgccgtcatatccacggtatcaaactgcgtcttacagtttgaacagttcccacagtaattgcttccgtattccccaaaataccgcagaatataatcacgcagacattcctttgtaaaacaataataagtcatctttttcaagcgctcctgatcccgctccatcacaatccggcgcgtcagttcatccagttcctgattgtcgcgattgttctcaatgaacatctggtttgtgatcacatcctgtccgctatataaaagcaggcactcccccggctcaccgtctcgggcgcagcgtcccacttcctgataataggactccaaattcttcggcatattgtaatgtacgacaaagcggacattggatttatcaattcccatcccgaatgcattcgtcgccaccatgatctgctttcggtcataaatgaaatcatcctgattatcacgccgctcctggtctgtcagtcccgcatgatacctggtcacggaaaacccatccatttccaggagtgcgcaattttcctccacctgctttctggtcaggcagtagacgatcccgcattgatccggatgctcctcaataaatgctttgagtgcggcatatttattctttgggaactgtaccgcaaggaacagattcggtctgtcgtaacctgtcattactacttccggatcctccagcatcaggatatcgatcatatcctctcttacttctttcgtcgctgttgcagtaaatgcactcacaaccggccgctttggaagatactctacaaactctgtgatctttaaataacttggccggaaatcctgtccccactgggaaacacagtgcgcttcatcgactgcgatcatagaaatatccacgctcatagcaaaatccataaactctgcagtttccagccgctccggtgccacatagataatcttatatcttccttcttttgcaaaagcaagtgccttccggtactgccccatagtcagggaactgttcagataggctgcatgaacccctgcctggttgagggatgccacctgatccttcataagagaaataaggggagatatcacaagtgtaatacctcccatcatcagagccggaatctgaaaacagatggactttccagctcccgttggcagtatgccgagtacatcccggccggacaggatcgcatcgatcagtttctcctgtcccggtcggaatccgtcatagccaaaaaattgctttaatacttgaaatttatccaagatatactacctcttcttccggtttttctgcggattccatctccagcatataaagaaccggctgctttggaaccatcggacggtacgcttcgtactcgaacttgacggttacttttttccagcttctctgtgtgatctgcgctgcccttccaagattacatggatatccatagaaacggatatcatctgcgcagcaggtcatgatctgtcttcccggaatcagcatatttgccggcattcccttcggacggaaaagctgtgcaaggaaggtgatcttcttgtgctcgtaacgctccggatgctcatatgcatccacataccaggtcccaaagtccacatcatcaatgaagatatggtctgctttcagatcatatggcagatcctcttctgtctgcgggataatattgccatccacgccttcaaaaatcagctgtgcttgtgggttctggatcttaagggcacgtctgaacgcacttcggtctgtattttccccacaacggttgatgatgatcaactcagattcagtaagctggttcatcagcatattccgcatattcttcaggtacatgtccagcgtctcaccgctaaccgttgagtacacaccctgaatctcccagttgcgtgggaaatcttcatccagaatttcctgcagatcccaggttccattgtactcaatgatcacctggaccggatgatagatcttctcacagttttcaaagaaagttttatttaacttttctctttcttctatattgaagaggaacagtccattctcatccagatatttttccgagtactcttcctctccctcttcacactgcaaaagcaatgtcggaccttcttcgatccattcctgcttcatcagtgtgtctttgataaatgttgtttttccactgtccagaaatcctgtacagatatataccggtgttgtcatcgccgcttgctcctcctagatatggaataacttaatcagatcctcttctttgagatctgttccgatcacgcatacacgtcctgtgtaatcagcctgtccctcacggacttcatattcttctggaaccatatcaaactgcttccaggaaccgtctgccatctggataattcctttggaacgaagtacggttccgtaagcatctgtctcagataatgctttcagcaggtaatccagttcttcttctgtatacttatgagcagtctccttgccccagctcgtaaatacttcatctgcatgatgatgtccttcgtgtccgtgatgatggtcatggcatccgcaggtgcagttctcatcatgttcatgatgatgctcatgctcttcatggtcgtgatcatgatggtgttcatggtcatgatcgtggcatccgcaggtgcagttctcatcatgttcgtgatgatgctcatgctcctcatggtcgtgatcatgatcatgaccgcagccacattcgtcatcatgatgatggtgatgttcgtggtcgtcatgctcatgtgcatgttcttccaggataccttcgatctcagcaccatgctgcagggcatgcaaaacggcatcttttccaagttcttcccaaggtgtggaaataatggttgcctctgcatttttctcacgcagcatatgcacgcactcttctaccttttcatctgtcatcatctgggtacggctgataacgatcgtagatgcatgctctacctggttattgaagaattctccgaagttcttgagatagatctttgctttcttaccgtcaacaactgtgattcttccgtcaatctcaatatctgcctcatctttgacaccctcgattgcttttacaacatcagaaagctttccaactcctgaaggttcgatgatgacacgatccggtgtataatctacaagtactttctgaagtgctttgctaaaatcccccaccagtgtacagcagatacatcctgagttcatctctgtgatctcaacgccggcatcttttaagaatccgccatcaataccgatctccccaaattcgttctcgatcaggaccagtctttctcccggaaatacatcctcgatcagtttcttgatgaatgttgtctttcctgctcccaggaaaccagaaataatatcaactttcgtcatttttcgttcctcttttcttattattataattccataaattagccttttctaactgcaaattgtttccgagctatatcgtatcacatttctttaaaagatgcaaataaatagcttgttaatgcattgtgattagtgtataatagttttataaaatctcgtacttttttagtacaaattcataaacaaaggagacttgataatatggttaatttattgacaggcccaaaaggaagcggaaaaacccagcaaatgatcgaacgtgctaacgaagctgtaaagacatgtgaaggaaacgtattcttcatcaagaagagccacagagatacatacagcttatctttcaacatcagagcgatctgcatggatgactatgatgtaatcaccaataccgatgaatatcttggatttatttacggtatgttaagcgcagaccatgatatcaaagcaatctttatcgacggtattttaaagcacgccgacatcacacttgagaacattccttctttcatcgaaacactgaaaaagatctccaaagaaaatgatgtagatttttatgtcagcatcagtgcaacgaatgaacagcttggtaatgtagattttgaagattgtacactccttaactaagatagacattatccaaaaggagggatgaagattttctgtaaatcttcatccctccttttatggttttccaaatgtgacagagcacattctttttatgctatgataccaggggcaaaaggtcagaaagccgatgcaagcttgcttgcaagaggatttttgcactctcgcaatctggtatcaaaggggtcaaaataccttttgaccccaacatcatgctatttcaaagacaaaaccgtatttgccttatccccttttgcatactccagttttacatcatctcccacattgtacttgatgatctcaataaaatcgactaccgatacatcaaaaatctcatctgatccttccagcataatgtagtaatgagaatctccatctataacgccctgggcgattttcgtgatctttccttcgatcgtgccggtatccatcttcacttcttctttttccttgattccattggtaagaagcaaattattgtaggattcttcacatacacttaccgtatccccgatcgcaacaacctggtacttctggacattgaccattgcatactttttcacaagtcctgcatcatccttaagtgccataaagtaagtcggctccccggaaatgttaagcagcagcgggaaagtcgcccgatacttcaggttctgtacctgtccttctgccgatgccatcgcagaatcctcgatcgcacctgccaccggataatactttgtctccatagttctctggttcatcagaacaaatcccacattggactggtcactgtttacagaagttactcccgtgtacacccatacatcatcatcaattgccagataattatatccgtttgttgtcttcagacaatctttctggctgagtacactgttaaaatacccatgctttaacgtgccataataatcataaagctgtaccagaagatctgccgaataggctcggtcgatccattccgggacttcatcgatcctgtagtcctgcatttcgccggtgatcgcattgcagagcaccacatgccctaccgtttctcctccgaaaagaccgatattatactttttgaccggtgctacccagtatggaacaccattatcatcaatttcaaaactaaggtctccgtaaatataagtcggatgcgcaaaacgaagatgacggtaaatatttcttccaaaatgctcgctggtcgaatacttcattccctgctccagctttaccatctccgttgtctgacttgccatatcgatccggatatatgcaggaagtccatctctccgattggtaaaccatttgatcagattcgcatatttcaaaggtgacacacggaccggacgatccttgtagttgatctgactgtagatatcgtccacctcaaactgggataccatatctgacatgcttcccatcttccggtctcctaaaagctgcgcagactccttatccagaagcgggatctggtcaaaggaaagctcctcgatatcttttgtgaattcaccctcttctaccttcagaagctgttggtatttcttcgcattcacaatcggtgaagaaagaatggttccggccagataaatcactaacaaaaaaataaaaagacggacacaccatttgaaacctttggattctttcatctccttcagatcaatcgctccgtatcgcaagcctttttttcctgcaaacacaagaccgaccgcaagcaccagaacaagcacaaaataccacactccggaagaatggatattaaaagccggcagtgatacataataccagattcctgctgccactaaaagcagcagaaaactgatcgctatatttttctttttcataaattctccttttcatcgttttgccttaccaaagctgtcttagaattttctactccaaagtgacggcgagaacagcatcaggaacgggaagatctccagtcgtccgatcagcatatccacgcagaacacaatcttcgagaagtctgagaacttcgcaaaattttccaccggtcctaccagattcagtcccggtcctacattattaagtgtagtaagcactccggtaaatgaagtagtaaaatcaaagttattgatcgagatcagaagcacggatacgatcaggattagtatatacgcaataaagtatatatataccccccgcatcgtctcttctttcacttttttaccatttacttttacgatattgactgctttcggatggatcatagttttcagctcccggcggatgctttttaccaggatcagaagtcttgatactttgataccaccgcctgttgaaccggcagaagcaccgattaccatcacaagaagcagaacacatttggaaagctccggccacttgttgaaatctgccgtcacaaatccagttgtcgtgatcacggatgccacctggaacgccgcatagcggaatgcctttaaaagagaatgataacctccggcgatattgcaggtgatcacaacggttgctcctgcaatgattcccaggtaagcacgcagctcctcattcttaaatacactcttaaattctttcaaaagcagaaagaaatacaggttaaaattgataccaaacaggatcataaatacggtgatcacaccatcaatgtaggcactgttgaagtgtgccacacttgcattgtagccggaaaatcctccggtaccggcagtactgaatgcatgtgtcactgcgtcaaacaggttcatccctcctgccagaagaaaaactacctcaattgtagtcagtgcaaaatacattccatacaggatccttgcggttcctcttgcctttggaaccagtttatctgcctctggccccggaacttccgcacgcataagatgcatggaattcttctcatccagagaggtaagtaccataacaaataccagcactcccattccaccaacccaatgtgtcagggaacgccagaaaagaattcctttcggaagtccttcaatctcagtcaggatcgtagaacctgtcgtcgtaaatccggatactgtttcaaaaaaagcatccacatagcttggaatacttttactgagtacaaatggaagtgcacctgcaagtgaccagaaaatccaggccgttgcaacaatgatcagaccttctttggcataaatcgtcatgttctccgggcattttctgccaaacagcagataaattgccgtcaggatcgcagctgtaatcagaaaataaaccgatgtgtgctcgccataaataattccaaccatcatcggaagcagcatcagcagtccctctgctcccatcatcttactgatgatatagcgtatcattttcacattcatttcttttcacccctattgctcagccagaatatctgtgatatccttaactttcttctgggtcgtaacgattacaacactgtcgcccacctgaatggattcatccccgtccggaataatgatctgccgttttcttccgatacatgcgatcagattgttcggcttcagttccagatccttaaacgggatatctgtatattctgttttttctttgataataaattccagtgcttctactcttccgccaaccagctgatacatagattcaacattgacattcttgagagaattctggcgtgcacgcacataactcataatcgcatctgctgttgcagtctttgccgatacgatcagatcgatcccaagttcctcgacaagctgggcacgtccgtcttcgttgacctttgccacgatcttgtccacaccttttgtctttgcaaaaagtgcaaggataatattctcctcatccataccggtcaggctgaccagggcatctgcctgttcaattccttcttcgatcagaaggtcatggtctgcggcattcccacagatgatcgtcgctttcggaagctggtcgcagagatcttcgcatttcttccagtcctgctcaatgatcttaacctgcataccaagtcctaaaagctgttttgccagataatatccgacttttcccccaccacagaccagaatattcttcggctctttccgctttccgatcagatggaaaaattcttcaatatatttgtgggatgcaacaatatgaagccggtctccatcatggatgacaaaatcaccattcgggatgatcacttccgatccacgtcttacagcacataccagaactttgatctggaacttgcggtaaagctcagcaagcgatactccgcccagatggcttctttctttgacaatgaattctaccatttcgacttttcccttcataaaagtctctacctttgcagtatccggaagaaggatcgatctggaaatctcaaatgcagccgcaagttccgggttgacagccatactcagtcttaagtcctctttcaaaagatcgatctgctgataatagatcggattccttacacgagcgatcgtgtgctttgcccccagtctctttgcgagcaggcagctcagcatattcagttcgtctgtcgatgcacatgccacaacaagatcagcgcccggcactcctgcttctttctgcactttcgcatctgcaccatctccggtaatgcagagaatatcaagctgattcagtgcttcttttaatttcccctcattctggtcaatcaaaaccacatcgtaattttcttcggataactgtatggtcagtttatgaccaaccttcccgtccccaataattacaattttcatttttcttttcctctactttttctcttaatactaaacctttaatactaaaattgtataaaataccaatgtgacagccgaagctgccaccatcataatatgtataccacttttagtacgaaagtacaatagaaaaaaccgggattttctcccggcttttccttattcttattcttcagctgcacgcttttcaatttctttttcctgtacatctgccggagcctgttcataacgggcaaattcatacgaatagcttcctcgtccacctgtcatagaacgaagtgttgtgcaatatccaaacatgcctgtcatcggtacatccgcttcaattacctgatatccgcctgactgtggattcattccaagaacacggccacgtctcttgttcagatctcccataacgtctccggtataatcatccggaacggttactttcacagatgcgattggctcaagaagaaccggtcctgcttccataaatcctttcttaaatgcctggatcgtcgcagtcttaaatgccatttcagaagaatctaccggatggtaagatccatcatacagagttgctttcacaccaactaccggatatccggcgagaggtccttttaatacagattcctgcaatcctttttcaaccgccgggaagtagttcttcggaacagcacctccgactacttcttcctggaatacatacggtgtatccagatctccggatggttcaaaacgcatcttaacatgtccatactgtccatgtcctccggactgtttcttatacttggtatctacatccgagttcttgcggatcgtctcacggaacgcaacttttggtgtctccagtctgattccgactttgtaacgctctgccagcttgcttgctgtcacttccagatgctggtcacccattccataaatcagtgactggcggttctcactgtcatttaccactttcagtgtcacatcctctgccatcatcttcgcaagagcctgtgataccttgtcctcatcacctttgttattcactacatacttcatatatgtatacggtttggagtattcggttcttccataagataccggtgtattttttgttgaaagggtatcccctgtctttgtacttgtcagttttgcaatcgctccgatatcacctgcaaacagttcctgaacttctaccggtttgttgccggataaggtgtagatcttgccgatctttgcttctgcatctgactccggattgtaaaggacatcatccccctttaatacaccggaacatacttttacgaaagaatattttccgataaacggatctaccatggtcttgaatacatatgcggtctttgcggctgcaaaatcatgatgtgcttcaaagatctcattggtcttacggttgatgcctacgcattcacggtattccggacttgggaaaaatcttacgatatcagacagtaagtttgcaacaccctgtgcctgaacattggatcccattgctaccggaacgatatctccgtccataacttctgttctcatggcagagcggatctcttcaaccgagaattcatctccctcaaaataacgttccataaatgcttcactggtctctgccactgcttcaagaagcttctctctgtaaatctgcaggttcggcagacagtaatccggaatctcacactcttctctctgtccaagtccggtgtatcttctacctgcattcttgataacattgacataacctactaatttctcgttctcacggatcggttggaaatgtggtgcaatcactttaccgtatcttgcggtcagatcttcaacaacctgacggaagctggcatcatccacatccatctcagtaacatagatcatacgcggaagattatacttatcacagagctcccatgctttctcggttcctacctgcacaccggcttttccggaaacaacgataacagctgcatcggctgcgctgactgcttcttccacttctccgacaaaatcaaaatatccaggtgtatcaaggatattaatctttgctttttcccattcaatcggaatcagacttgtgctaagtgagaatttacgtttctgttcttctttatcaaaatcactgatcgtattaccgttctcaacagatcccatacgatttgttgctccagatacataagccatcgcttctgccagactggtctttccgcttcccccatgtcctaaaaggaccacgtttctaatttcatccgttctgtaaaccttcatgcttgctgcctccttgctaaagtttctcatggatatattgtactaaactttctataaaaacacaactattttatagaatttcaacaaaaactttcacttttacactttaaagtattgctttattgacagatagcctgttttcctatattatgaaaggtagactatcacgaaaggacgaaagattatgaaacagaaaaaaatcggatttatcggactcggactcattgggggctctattgcaaaggcgatccggcgatattatccggattatgagattgtcgctttcgacaagaatagagaaactctggcacttgccacacaagaatccatcatcaatgtggcctgtacctcaatcgatgataatttccgaggctgcaactacatcttcttatgtgccccggtcgctttcaacactgcatatttaaagcagatgatgccttacctgcatgatgatatgatcctgactgacgtcggaagtgtcaaaactccgatccatgacgagatcatccggctgggactggaggattactttatcggaggacacccgatggccggttccgaaaagagtggttttgccaattccaaaccaatcctgattgagaacgcttactttgttctcaccccttccgccaaagtagcgaaaaaaaaggttgatgcatacgcatctttcgtagaatccttgcgtgcacttccaatcgtactggattatcatgaacacgacatcgtcaccggcacgatcagccacttgccacatatcattgccgcaagtctggtcaactttgtcagagacaccgacaccaaggatgagctgatgaaaaccctcgccgccggcggctttaaggacattacgcgaatcgcctcttcctcaccgaccatgtgggaacatatctgtgcacagaatcagagtaatatttcccagatccttggaaattatatcgaaacattaaatgaagcgaaaaaactggttgatgccggagactcccagggaatctacgatatgttcgaccattcccggaactaccgcaattccatgccaaacggttctgccggcccgatcaagcgtgcattcgagatctactgtgacatcccggatgaagccggtgtgatcgccaccattgcgaccatcctcgcttctaatgcactcagcattaagaacatcggaatcgttcataaccgtgaatttgaagaaggcgtactccgcatcgaattctatgacagcatctcctgtgagaaggcagtagcacttttgcagaagcatcgttatattgtttatgagcgttaataattaaatgatgataccagggtcaaaaggtcagaaagccgatgcaagcttgcttgcaagaggatttttgacctcttgacccgccaaaaagcatgagtaagtagccatttttcaaagaaaaatgagcggattacgaatgtttttgaggattgcgggaattgcaagacagtccaaaaaatcttttcagaactttgtgtaaattggtcacaatgcttgaaaatagaattttacgaatgagaggttactatattatgcaaatccaacctgttaaacagcttcgcggggaagtatctgttcccggcgataaatccatctcccaccgttctattatgttcggtgcactggcaaaaggaactactgagatcacacattttcttcacggcgccgactgcctctctaccatcggctgctttcgtgccatgggaatcaatatcgaagacacacctgaccgtatcctggttcacggcaaaggtcttcacggactttccgaaccttcttcttttttagatgtggggaacagcggaaccaccacaagactgatttccggtattctttccggtcagccgtttgccaccactctttccggcgatgcttctctgaactcccgcccgatgaagaggatcatggagcctcttgggatgatgggcgctgatattttaagccagaatgggaacgggtgcgcaccacttttgatcaacagcctgcttcctgccggtcagaatccatccctgcacgcaatccactatcactcaaaagtagcttctgctcaggttaaatcttccgtactcctggcaggactttatgcagacggattaaccctggttacagaacctgtactttcccgtaatcatacagaactgatgctgaatggcttcggtgccaacgtacagacagaaatacattctgatggcagtgcaactgcatctattctcccatgtgaggaattatacggacagaagatcctggttcccggagatatttcttctgctgcttacttcatcgctgctgcccttctggttccaggttctgaacttctgataaagaatgtaggtactaacccgacccgtgccggaatccttgaaatatgcagggcaatgggggcagacattacctatctaaacgaaaattgtgacagtggtgaaccaactgccgatcttcttgtacgtacaagcgctcttcacggaaccaccgtagaaggtgcaatcatccctacactgatcgatgagattccgatgattgcagtgatggctgctttcgccgagggaactacgatcatcagggatgctgccgaattgaaggtcaaagagactgaccgtatcaaaacaactacagaaggacttcttgccatgggcgttgatgtaacaccaaccgacgacggcatgatcatccgtggcggtaatccggttcatggaggacagatcaacagttatctggatcaccggatcgcaatggccttttccatcgcagcccttgccgccgagggaaatactgaaatccaggatggtcagtgtgtagatgtatcttatccttcattttttacggaacttcattccctttccctgtaatttcaggaaaaaatacaaaaaaagaaagccgcacactacataagtagtgtatagctttcttttttatgcgccctgtcactgtttctctaatccgtgaatccagtctgtcttaagaaacagaatcaaaaatatcaccgaactgataaaccaggtaagtggatatgcccagtagattacattgatcaccggaataatcctgataacaatactaatataggttacccggactccgcaccatacaagcatcataacaaacatcggaacaatacttcttcccgcccctctctgaattgctgccatacaatgcgaaaacgcaagcagacaatagaaaagagcgatcgtatgtgcctctgcaattccatattcaattgctttttgatctcctccaaacgcagcgatcaggtatggtgaaaagaaaaaaactgctattccgatcacttctgctatcccgattccacaaatggttccaaacaatgcccctttttttgtccggtcatactcttttgctcccagattctgtccaataaacgtcgtgagtgcctgtgagaagcaggtaaccggaataaatccaaatccttcaattttggaatatgacccacacccggccattgccagagccccaaactgattaatattcgactgtacaaatacatttgcaaccgcaataatggaattctggattcctgccggtattccgtttaccacgatcagccgcagcatattcccattcatccgaagttcacgaaaagataaccggaacgcctctggttccctgcgcagttttctgatacacagaaccgcacttaatatctgtgaaacaatcgttgcaaaagctgctgcacctacaccaaatcctaaacctccgatcagcaccagatccagaatcacattcagacacgctgaaatgatcagatagatgaccggactcttactgtcaccaagtgactgcaaaatccccattccaaagttataaattacaaatccaagtgaacctgcaaaatacaccctgaaataaaccagtgatttcggcagtacctcttccggcgtaccaatcagttttaaaatctgcggtgcaaggatcaacgcggcaaccgtaagaaaaattccacatacgccaccaaatgccagtgccgtatggattgcttttttcagcttctcatattctccggctccaaaatacctcgcaatgacaacaccggctcccacgccaattcccccaaaaaatcctaccatcaggaatatcagattccctgatgagctgacagctgcaagtgcattattcccaagaaaatttcccacgatcagcgaatccgccacattatacaactgctggaataaattcccccatagaagcggaatcgcaaacataataatctttttcggaatagatcccgttgtcagtagattagcgtttgatgtttcccccataattaaacttgtcctcctataatattttaagtctattatactcctgatacggttaattcaccagcaaatatatcggaaacaatatttgattcttttttaataaatcataaatctattttttcatcaattattataacctttttaaattatccttcaatgtatattgcattttccatcctcttctattaaactattatgatatatactataaattttttgggggaattttctatgcaaaattatcttgaatttatcggaaacgaactgaaagctttaacttctattccaagcccatccggttataccaaagatgtggctgcatacctgatgaagactttatcagatatgggatatgaaccacagctttctaacaaaggcaacgtattcgtaacgatcggcggagaggggaatccgctggtacttgcagcacacgttgataccctcggtgccatggtgcgttctgtcaaagcaaatggaagactgcgtccgactactctcggtggacaccagtggagtaccgctgatggggaaaactgcacgatccacacacgcgacggacgcgtttataccggtgtagtactaaatactgaaccttctgttcatgttgcagattctgctgttgagacaaaagaagaaaatatggaaatccttctggatgaaaatgtggacactaaagaaggaactctttcacttggcgtacagcctggagatatcatcgccatggacccgcgtacccagatcacaccgagcggttatatcaaaagccgtttcttagatgacaagctttctgcttccatccttctcggtctggcaaaatgcgtaaaagatgaatctattgcgctttcccgcaaagtttctcttcttttcactgtatatgaagaagtcggacacggcggaagttttgttgccgaagatacaacagagatgatttctgttgacatgggctgcgtcggatccgatctcggatgtaccgaacgcatggtatctatttgcgcaaaagattccggcggtccttacaactacgacgtaacatctgctcttgccgaaactgcaaaagaagaaggattggattatgcgatcgatgtgtatccgcattacggttctgatgtagaggcaactcttcgggcaggatatgatatccgccatggtctggttggtcctggggtgtatgcatcacataactatgaaagatcccatatggatggggtaaagaatacgcttttgttgttgaagaagtatattcaaaaataaaaagtataaatagctaacgttcaaaaataaaacatctgcgatatgcataccgcagatgttttattttttcaatattagtcatatttttcttaagtccgttaaatgcaagtgcctcttctaccagttcttttctctttttcttatcttgtcatgatctggatgatcgttttatccgtctcacgcattcccttctttgcaagctctccaatattacggatcgtgttttctacacctttttctacaagtccgtctccgccatagaactgctttccatttttctgcatctgaagtcccagaagccctgcttctacagctgatgcgatttttgccgcgcagcttgccttcgctccatcacacacaacacctgagttaatggcaactgcatttacaattacatgagaaatctcatatgcacgtccgccatacagataacagattcctgcacctgcaccacatcctgcactgatcgcgccacaatatgcagacagtcttccgattcctgtcttcatatggattgtgatcagatttgacacaaccagcgcgcggagcatcatctcttttgagacatttagctcttttgcatagacgatcaccggaagagaagttgtcattccctggttaccgcttcccgaattgatgacaaccggaagttcacatccgttcattcttgcatccgatccggccgctgccatcgctttcgcacggttatgtacactgtttccatatgcttccatcaaagtctttccaatggcagctccccagtttcctgtcatgccctcttcggcaattgcccagttataatcaatctgtctctgcagaacttcctctacgtctgcaacgtctacgcagtctgcgaattcaatgatcttctccacagtcagaagagaacggtccgtcgcacagctggatccctgctcttcatatgctttttctctgatgatctcatcatctttctttacacagatcacattggtgtgaaaacctgcgatctctacgtatccgctgtgtccgcctgcacatgccttgatctggatgtcgaaaatatattctttatcggattcccggattgtcatcggcatggtatccagcatctttttcatttctactttctgttcccctgtgatctcttccagaatttccagttctttttccggacatccggctacaatccctgcacagactgctgcaccgattccgcgaagtcctcctgtgcacggtacaacgacactttttacattcttaataatatttgcactgacatttacttctacagattccggtttttccccaagagcctgaactgcaactgctgccgcgtaagctactgcaatcggctctgtacatcccatcgccggaagcaactcttcctttaaaatttccacatattcatcgtatattttttgttccatcttttctctcctctgtcagatgacaccccattcatctttttattgttccctgtttattttatagtattcctgcctttcccacaagcttttctctctattttttcagggtttacataattaccatgattacattccaaaaatattcttttatttttatttaacgcctccgaaaattttcctgtaacattttttagtcaaatttctctgttatatcatcacaaaatgccgggcaacattttgtactgtccggcatttttctatcctgtagcaatttattttccaatctcttctctagtctctttaaaacatttgataatgaaatcaatatcttcttttgtatggctcgcgcatacctgtgtgcggattcttgcttttcctttcggtacaaccggataagagaatgcaaccacatatacccctttttccatcattttctttgcatattctccggcaagtctttcatcataaagcataaccggtacacatggatgggttccttcgatgatatcaaatccattttctaccagctgcttgcggtagtatgcggttacttcttccagatggtcacgaagctcggtgctttcttccagcatattgaacatctcaatacttgctcctgcgattgccggtgcaagagagttggagaacaggtacggacgacttctctgacgaagcagatcgatgatctcttttcttccggatgtatatccaccggaagccccaccgagtgcttttccgagtgttcctgtaatgatatccactcttccttctacgccacagtattcggaagttcctctgccgtgtgctcctacaaatccaactgcatggctgtcatccaccataaccagtgcgttgtatttatcagcaagatcacagacaccttttaagttacagatgattccatccattgaaaatacaccgtctgtagcgatcagtttgactcttgctcctgctgcatctgcagcctgaagctgtgcttccagatcttccatgttgttatttttgtagcggtatctttttgccttacagagacgaactccgtcaatgatggaagcatggttcagttcatcactgatcactgcatcctccgcagtcaggattgtttcaaaaagtccaccatttgcatcaaagcaggaagaatataaaatcgtatcatctgttcccagaaatccggaaatcttcttttccagttttttgtggatgtcctgtgttccgcagataaatctgacagaagcaaccccatatcctttttcatcataagttctcttcgctgcatcgatcagtctctgattgtccccaagtccaagatagttattggcacacatattaagaagctctcttccgtcttccattacaacctttgcgccttgcggagatacgaacggtgcttcccctttgaaaagaccatctgctttgatctgttctacttcttttgtataaatacttaaaatatcattttttcttgccattttattctctccttcttctgcttttcctaatcgttaatatgtgcccagtcaaggatcacctttcctgactgtcctgagatcattgcctcaaatcctttttcataatcgcggatatcaaaatggtgtgtgatgatcggtgaaatatcaagtcccgcctggatcatcgtagacatcttgtaccaggtatcccatacttttcttccataaattccgcggatattcagcccattgaagatcactgtctcaagatctacggttgcatcctgtctctgcaatccgagaagtgcgatctttccaccatgtttcatgttatggatcatatcagaaagtcccggctggcttccggacatttcaagtccgatatcaaagccttctgtcattccgatctcatgcatcacatccgtcagtttttcctgtgtcagattaacgcatctggtcgcacccatttttgctgccagatccagacggtactggttcatatccgtgattaccacatgtcttgctcctgcaaattttgcaatcgccgctgccatgatcccaatcggccctgcacctgtgatcagcacatcttcaccaagcatgtcgtaagataatgcagtatgggttgcatttccaaatggatcaaagatcgcatataattcttcatcaattgccggattgcacggccatacatttgaagcgggaataaccagatattctgcaaacgcaccgttccggtttaccccaacgcctttggcatctttgcagttctctttgtgcccttctagacagtttctgcattttccacaagtgatatgtccttcaccggataccagatcgcccaccttgaatccctgtacacctgcaccgacttctacaacttccccgacatattcatgtcctgcggtcagtccgatcggaatagtatgctgtgcccattcattccactggtaaatatgtacatcggtaccacagattgcatttttatggatcttgatctttacgtcatttggtcctacttccggaatctgtactcttttcagccagagtccctgttccggtttttcctttactaacgcccacattttattatcattcatcttcattacctccgcatgacacatatgtccgtttaacgcggactttttattacttttgtttttctatacttaggataccctatttttcttctcttttcaatctattttccgtgatacacaaacattttacatgttcatgtttttgtagcagatacaagcacatgtgtctttctattgcaagcacatttattatatatatacaaaaacagacagataaatctgtctgtttttcacaatgccctactgtcgattttcacaatttcgttctgtttataacaatcttttttctttctgatgtaccctttttctcacaaaatagaagcacacgacctgaagtacaatggtaaggatccatgacaccggataggatacaaaaagtacggataaagatctgtggttcggaaaaattccaaatacccacacaattcttgttcccaccgttccgatcactgaaagcaccatcgggactgctgaatatcccattccacgaagcgcacccggaaacaaatccatgatcccacacaggaaataagtgatcgatgtatacgccaggatttccattccgcagttgataacctttggatctgaagtataaattgtcagaatctgcggtccgaagcaataggcaagaccaccaagcactaccgcgatcgatatagacagaatcgcacagtcacgcagcaccttatccattcgtttcagcttaccgacaccataattctgactggtaaaactcatacatgcctgggtgatcgaattcactgacatataaaggaacccaagcatattgttcgctgctgtatagcctgccatcgcaatcgatccaaatgaattaaccgaggactgcaacagtgcattggacaaattgatgaccgtactctggattcccgccggaactcccacctggaaaatctgttccatgtaggcaccattgatcttcagtttggagaaacgaagctgataacttccttccgaccggtacagacaggtcagtaccagcacacaggaaatcagctgtgaaataattgttccaattgcaaccccggcaactcccatatgaaaaagaataaccagtatcatgttcagcgcggcatttgcaattccggaaatgatcaggaagatcaatggcctttttgtatcaccaatcgcccttaaaatggccgccccatagttatataacataaaaaatggcattcccataaaatagatccgcatatataaggcagactgcccgatcacatcatccggcgttcccataatttcaagtgcccactttgcaagaagcaccccgataactgccatcataattccactgatcagcgcaagtgtgatcgaagtatgtactgtttccgacatctcccggtctttgcccgctgcataaaatctggctgcaagaacattggcaccaagtgaaattccgataaacaggttcgtaaacacattaatcagtgctgttgtggagccgactgcggcaagtgcctgactcccggagaatcttcctaccacgatgatatccactgcattaaacgcaagctgcagaattccggaaaccataagcggcagtgaaaaagagatcagcttgtccatgatggagccgttgcacatatcaatttcaaacttattttttttcacattattcacccagcccttcatcaaatgtaagtctcatctgattccagaccacgtttccatgtactgattctgagacaccttcatttttgaatccaaacctggcataataagatatcagccggtccttgcaggtaaggacaagtccctttcttccctgctcttttgcatctgtaatcgctcttttgatcaattctcctgcatatccatgtttccggtaagacggcagcgtatttacaccaaaaatcatctgccagtcacctttttcatcatgcatttccgctttttcatacatttcgtctgtcagatcttcctgattcgtcaccataccgtccacgaaggcgatcaacttctcttcttcaaacatcagccagaaatgatctttataaaaagtaagtctcttttcaaattcttcttctgttgccgcttctgctgccgggaaacacgctgcctccacacgggcaatttctttcagatcactcagatctgctgttcttattctcatctttactctccctcttttcctaatattttcagcattttttctacattttcgctggtccatgccggaaattccagtaccgcatccgagatatcctgccttccggaatccgggttgtggaaccagatacatttcataccggctgctctggcagctcctccaccgttagtcgaatcctctactaccagacagtcctccggctccattcccagtttctctgccgttacaaggaaagtatccggtgccggttttggatgctctacataatctccactcatgaccactgtaaaatatttctccatatccagagactttaatgcatctttgatcgcataagccggagaggaagacgctactgcaagcagatatccttcgtcttttaactgcttcaatgcttctttaattcccggcatctccggaaatccttctgcctctgtaatctgcgcttttttctctttcatgagcgcattcatcttatccacatcatcaaaaaccggcccataattctcattgatcaaatccatgaagaatccacgggtagaaccgatacacggaaggtaaacctcatagtcaagatcgattccgttcttctcttttaaaatttctttccagcaacgatagtgtaatggttctgtgttgatcagaacaccgtccatatcaaaaataactgctttcatatctttttagcctcgattaaatgatttaaattctctttccgttcttattttgaatgacgtttttaaagatgtcaagacggagaagctaaaaagaatgtgccaaggcacattctcgcgccgagcgcagtcgcttgcgacattcttcatcttcgtgcgagtgcgcatctccggcacacagtgccttttatttcataggaaatttcttcggaatttcctatgaaataaaaagagagcgactgtacgattcaaaaaacgcacaggcactctctttggcttttatggatttttcttaaggtctctgtcccattccaccttctaaggtgatcgtctctccgttcatatatttgaaatccggtgatgcaagctgtacgcatgcacgtccgatttctttttctacatctccgtaatgtccagccggcggcatctttacatttgccttgaatgcttccggataagctttctggaaattctcaagctgtgctgtccatgcgagcgggcatacgatattgacattgattccatctggtccccactctgttgcagctactctggaaagtccacggattccttcttttgccgctgcatatgcgcactgtccgtaatttccgaaaagtccggcacctgaagcaaagttgataacagatccctttgtctctttcagatacggataacatgcctgcatataatagaataccgcatatacgccggaatacattgccagattgaactggtctgttgtatgatctgcgatcgtaacaccagatgcggatgcctgtgcattattgatcaggacatcaattcttccgaatgtatcaattgcctgctttactacgttctgtactgttgcttcattatcagcccccgcgctgacatcagcctgtacaggtaatactttgataccatagagtctctccagttcttctttggcatcttcgagtttctttacattacgcccggtaattaccagattcgctccttcttttgcgtaagctgttgcaattccatatccaatagatccgcagcttccatcacttaatacagctcttccgccgcctgtgataattgcagtctttcctgttaaaaatcccataatcaatttctccttcctgctgtccttcaactagcatacaattataatagcagagtacaggtcagaattcaatactgaattgtgtctattttctgacaatatagttaattttttgattatcgcaaagacagttagaatgcaaaaacctcattaaataagggttgtttattatatagataccaggggcaaaaggtcagaaaaccgatgcaaaacgcacgtagcaatctggtatcaaaggggtcaaaataccttttgaccccaacatcttatctatctacaacatatacaatagtgcattgcagatacatgcggcaatattgctgccaccttttctgcctcttgccacgatatatggtgtgtctttcagtgaaaggattaactctttagactggacaacatttacaaatcctacaggaactccgatgatgagttctggggttaatttgccatcctggatcagttcatagagtcttacaagggctgtcggggcatttccgatggcaaagatgatttttttattgagggtggctgctttttccatgcttgcaacggcacgcgtggttccgttctttttggcagtttctgctacatcttcatcggacatgaagcaaagaacttcgcttccgtattctgcaagcttccgtttgttgatacctgcttttcccatctgggtatcggttacaatgactgcaccatttcggatagcatccagcgctttttctactgcaccttctgaaaacatcaggttcttggcataatcaaaatctgcgcttgtatggatacagcgtttgacgatcggttctgttccggggatcagatgcgtatcacccagttcttctgttatgatctcaaaactgcgtttttctatttctgcaggttttacattttccagttctatcttcacttgatatttcctcctttgatcgtcacaccgatcccgcatactacccggtctacctgatctgaatttgccgcaagtacggtacagatccttccggtcagttccctgtatctgcgatcaaatgcgtctaccggaaccagaccatagccgatctcctgtgtcacaattacaatatccggacacttttttgttagtttcgatgcgaaatcaattgcttctttttccgaccagttttctttttttatcatgctctggatatatttttcaaaatgaaagactccttctgcctcaaaaatattatctccttcacatagttccccatccgtccaatgaatgtatgggttctgcttttttgcatacgcaagcttcccctgatatgcaccgccgattatcattttcatttttttatatctttcctttcaaccggaattccgtacacaacttctgtcaccagatctgccctctctcccatccgaagatttagctttccgagaagcttcagatattcttccatctccggattatctgtcatgctgtctgaaaatacttcatttgtaacaactaccagatcatcactgaccttctgcagcttatggatccccgccagaatggactcttctgcattttcacctgctcctgacggatcgtacatttcatttgccacaagattggacatacattccaggagaacacttcctgtctcttttgtctgcaggatttctgcagcttttttaagatccgtatagcattcgattgtttcaaaccctttgcccgcacgaagttttctgtgacgtgcaattttctcttccgtttccttcccgaaaggtatcatagttgctatatagtagcgttttttgtttctttttgaatggctggcatattccataagcttctgctctgcatattcggatttaccacttccactgccacctgtgatcagatgaaacattctgctgcatttcccttctcgataatctcatatattttcttcatatccatattctcacgaactgcatttgcaagaatctgatactgcttctctttgtaagcatggtagtccatggagtgcatggcttcctcgccgtatcctttttcttccagaagtgccccgatcagtgcatccgctacttcccggtcatcaaaaatcccatgtacatagcagccgtacacattcttcttctgcgctccgtcccaccggctctcacctgtcacctgatcacagatctgtaccatcatcttatgatctgcagcatctttatcagaaaaaatagtttcccccatatggatctcatatccatccagctttgcaccggacattgcttttaagattccgttaacttctccgaaccttccggtaacacgggttcttctcttggtattttcaaatacagtaactgtaggaagcagtcccattgcttttatggttccaccacgttctaccccttccggatcaaggatctcttctccaagcatctggtaaccgccacagataccaaataccggtttccctgatgaggcatggcgcagcactttcccttccagtccgctctgacgaagccacaacaggtcttccatcgtatttttacttcccggcagaattaccagatctggattcccgaaatctcctgcctttgacacataccgaagcgaaacttcttccctgcattccagtaccgcaaaatctgtgaaattggaaatacgcggcagacggatcactgcaatatccagaagtgccgccttttctttccgctcaaacctttctgacagactatcctcatcatcaatatccgcataaatatatggcatcacgccacataccggtatctttgtccgctcctccagcatcctgatacctggctccagaattttcacatccccgcggaacttattgatcaccgtacctttgatccttgcccgctctttttcttccaacagcataaccgtcccgacgatctgcgcaaacacaccaccacggtcaatgtctccggcaagaagaaccggtgcatccaccagctcagcaagtcccatgttgacaatatcattctgcttaaggtttatttctgccggacttcccgcgccttcaatgacgatcacatcatacttttcttccagtttatgataagcttctaaaatagccggaatatattctttctttttacggaaatattccatcgccggcatgactcccgcaacttctccgtttacaattacctgacttcctacatcggaggtcggttttaaaagaatcgggttcatataaacttccggccggatcatagcagcttctgcctgcatgacctgtgcgcgtcccatttccagaccatctgccgtgataaaagaattgagtgccatgttctgtgacttaaatggtgcaaccttgattccatcttcctttaaaacacgacagagccctcccgcaagaaggctctttccgacatttgacatggttccctgaatcataatcgactttgccatattaaaattctccctgacctgcatagagaatttctcccagcgcatcgatcagtttctggttgtctcctctctgccgcatacaaacacgataatatccttctccgagacctttgtaattactgcaatcccggaccagaatcttctgttttttcagtttctcatataaatttataccacttcgcatcagaatgaaattggcatctgacggataatgggtaattccaagcttgtctaattcattttccatccagattctttcacggttcgtaaaatcacaggtccgtttcacacgcatccgctcttttaaagatgccatgcctgccgcctgtgccggtatcgatacgctccatggctgtctggactgttccatcttctccagaaattccatatccgaagtaacggcatacccgatacggattcccggaatcgcgtgcatcttagtcagtgaacggaggataaataacgttctccatctcttagtatctgcaagaatggatgccgtagctgcattttccgcgaaatcaataaaacattcatccaacaccatccggattccgtaagtctcgcatcttgcaagaatcttccaaagcatactccggtcgatcagctttccggtcggattatccggtgaacacaaaaataccatatcaatatcttcattcagaagatccagaaaatcttcttccagttgaaaaccagtcgcttctcttttcttataataacagatctcgcacccggtcgcacgcagtgcctgttcatattccgcaaatgcaggaaccggtatcagcgctttccttgggcagtccgcaagtactgccgtaaaaatcagatctgccgccccatttccacagataatatgctcagccggaacttccagtcttttcgccagagcacttttcagtttcctgcagctggcatccggataatttccaatttggtctattgactttcttgccgcttccactacagctcttccaggtccgaacggattcagattcacagaaaaatctgtcattcctttgtgtgtataaatatctccaccatgtacatattccataaccttttattccccttacatcagtatcatacaatatttcagtaatccaaagacaagaagtgtcagaagtgctgttccgtccatcagattaccggctcttaaaatatcttccggctcgataggacgcacatcatctccgattgtctctttcggatataattttccaaaataataggcatctcccgcaagctgcacctgaagtgcacctgcacataccgcttctgtctgcgcggaattcgggctggcatgctttcgcctgtctcttttccagactgcccacgcccttttataatccatccggaagatccatgcacttgcgatcatcaaaagtgctgatatcctggacggaatataattccatacatcatccattttagccgcaaaccgaccaaaatgtaaatacttttcattcttatatcctaccatagaatccattgtattaacagccttataaaaaaatccaagtggtgccccaccgatcagcataaaaatgagcggtgcgatcactccgtccgatgtattttcggctactgtttctaccgctgcctttgtcaccccggcctcagaaagatttccggtatctctccccacgatcatcgataccgcatgtcttgccccctccagattgtggtttacgagccgtacataaaccttcctgctttcatctttcaggcattttccggcaagaagctgataacaccagaaagtttccagtgcaaattgaagccagaagctgacctttccggcaagatacaaaagtccccacggaattccgaccgatgcgatcaccacaccaaaccataaaacacatcctgcgattctttcttttttctcatcatttttacaaaatacgcgcagccacttttccagtatcgaaatccagtttccaatgatccgtaccgggtggtaaagccataccggatccccgaaaatcgcatccagcgccattcctgctatacatgccatcaaagaactcatatttcctcaatctcctcaaactgtctctttccctgctgccatttttcttcctcaatttgaaaatgaaaaccttttccgtttttcacctgccagtgataaaattctttcttttccggatcaaatgcttccatcaccgacatgatcgtccccccatgaaccacaaaggcaatcttctttctttttccctttatcatcttttccatcatctgttcaaatccgcagacacaccgtttccggaactccatcggatcttctcctcccggaaatgcctttgtacctccagaatcaatccagctctgatactttggattcccagtcagctcctgataattcttcccctcaaaaagaccaaaatcacattcccgcatctgctcacagacaacctgctctgctcccggaaaaagaatctctgccgtctgcctgcacctcctgagcggactgacaatcacaagctccggcttccactcctcacgtccattttcttcttttttcagagtatgctccagaacgaactctgcttttatttcttcatctgtcaccccaatataccgcttctccaaattcccttccgtcgcaaaatgccgaatcagcctgatttccatcttctatacatctcctcttcctttccctgcttttcatttgattccctgcacaatcaatcccccaactaataatgccagctcacaaatctgcagaaagtatcccgccagatccccggtaacgcctccaaactgtttcctgctcatccagtaataatatccaaatactactcctgcaattataagaagtaccaccataccaaccggcgaacagaaatacaaatatactgccgccaggatcaggtatacgatcattgtgatccttactgcctttttctgtgctccatcctggaaagtctttacaagaccgcttcctcttgctgccggaaatgtcactacagcaatcccactgagtgctcttgaaattacatatcctgctgctactaccggaagcatctccgtccggatttcactccatacaccaaggcttacggtaaaataacagcagattccgatgaccgcaaaagcaccgttatgcgaatctttcaggatttccagtttcttttctttatctccccaggatccaagtgcatccatcgtatccataaatccatccagatggatccctccacttacaaaaaccggtatcaatgtcataaccgcagcaaacatcagtcttccactgtttactttcggaaaaatatttccatcaagaaacattcctgccagataaatgagtactccggtcacaacaccgatcagcggaaagaaacacatcatatatttcatattttccttgttccactcaatgcgcggcatcggtatttttgaatacatagaaaacgcaacgatcatcggttctaaaaatttcatctttcgtccttcccatccagtacttcatactgctctacgtgaatatcatcaaaagttcccattttacggtacacctgaagtcccatctcaagaagcggcatcgctgccactgctcctgttccttcccccagacacatgccacatgtaagaaatggttttttttctaaagcatctaaaatctttcttgacgcaggttcatcagacaaatgggatggtaaaatatatcctgcacattccggaaccatccgtaccgccacaagtgcagccactgcagaaataaagccatctatcagcaccggaatccggtagattgccccaccaagatatacacctgcaagtcctgctatgtcaagtcctccaaccttggaaagtacatcgatcgcatctgtcttatccggctgcatccgctcaaccgcttcccggatgacctgtaccttctttcgcagaccttttttcgtcagacctgccccctttcctgtcatgaccttcggatcctctccgagcaatacagaggcaaccgcactgctggtcgttgtatttccaattcccatttcacctgtcgcaagaatttcgtatcccgcttcggcacacttctttaccatctgaatcccaacttctatcgccgcaactgcctcttctcttgtcatcgccgcttcttttgcaaaattgtgtgtgccatacatcactttgtattctttctttgtcacagacggcacatctgttgccattcctacatccaccgggaaaagatctacctttgcctcttctgccatgatgcagacgcttgtctctcctcttgtaaagttatccgccacgattgccgttacttcctgtccggtctgtgtcacgccttcttctaccacaccgttgtccgcgcacataatgatcagcccgcgctttcgcagttcaaaatctgaagtccccttaatcccggcaatctggatcaccgcatcctccagacttcccagactaaacagcggcttccctaccgtcatccagtgcgcccgcgcctcttccattgcattttcatcaagtggttttattttctctttccatctggtctcttccatctgtaagtctaatctcctgtcttttcgatttgtctttgtcagctttttacttgcttctgtaggttctacacgcttctacaaagcgtttggccactttggggttggaataaaagtataaatgcggaaatcccgcaaacagattccccttcatatgaacagcctgccattttctcacaccatccggctttacggcaagtgtatcctctccgttttccgtagaatcccaataatggaactcatgcgcccggatcttctctccctttttcatatacactccgttcatttccgcagtcagctcaatgtatccgaatctggtaagtcgcccttttttgatcccttttcccggaagtacccccaccatcggatagtgctttccatcttccccttccagctcttctgccaaatatagaaatcctccacattccgcaatacatggaattccattttcaatctgctttcttacatcttttcgcatagctctgttttctgccagatgtttcgcacaaagttccggatatccaccaccaaataaaagtccatctaaatgttccggaagccttgtatcctccaaaggactaaacggaatgatctcacatccaagctcttttaaaagctccatattatccttgtaatagaaacaaaaggccaagtcacgcgctacgccgatacgcacttttcgtccggctgcttcctgttttgccttcaccggatgatactccatttcttttgcttcccaggcaattttcagcaccgattccatatcaagtgtctctgtcagaatctctgctgcccggtcaatctgttttcccaggttccctatttcctccggaagcatcagtcccagatgccgactctccagatgaaaagcatcctcctccggcacataaccaaccacctgaacctggaatcccattgtctgcaatccttcttcgatcatcttcttcatcttcggatacagcatcggggaaatccggttcagaatgattccccggatattactatcattccggtattcaatcattcccttcaatactgccaggattgtcgatgccatacctcttgccggaacaaccaggattaccggaagtcccagggttctcgcaacgtcataagtacttgcctcatccgaatccagactgatcccgtcatagtaccccatcacaccttctgtcaccacaagctccgcgccttccgcatgatgcataaaccgctctttcaagcgctcccggtcacaaaaatacagatccaggttctcggaatcaattcccagcacctcccggtgaaacataggatcaatataatccggtccgcatttgcaggcgcgtaccttctttccggcatttttaaatgctttcatcattgccattgtcaccgctgtctttccactcccactggcagatgccgcgattacaattccgggaattttcattctgtatctcctccgtctgaaataatataaatcggatttaacccggtcatcatatgatatcttccaagtttctttgactttgccacattcagttgtatgatttccggatctgcaagcagtccttcctccatcgcctccatcgcttccttcacggtttccagcgaaattgcattgatcacgatacggacgtccggattttttttctttatgcactgaataatttcttttaactgtcctgtactgcctccgataaaagcatgggtcggcatttccagtgcttccagtgcttccggtgcaactccttctataacctgaatctggtctgcccggaatttctgcatattcttcctgatcagttctgcaccctccggattcttctctattgcataaacgcggagattctctccttgaagagcagcctctatagacactgaaccggttccggcccccacatcatatattactgcattctttgtaagcttcaattttgcaatgctgactgtccgcacttcctccttcgtcatcggaacacttccacggatcagctcctcatctgcaagatgaattcctgttctcttttccggctttggattctcgatcagaatagtggtaagatcaccaaaatcttctgcctgaagctcgtttccttttttgatcacaatctcttcatccggataagacaaatgatttccaaccgaaacggttacttgttccagatggtaatatttcagtttttcgcagatctcttttcccgcacttttcccaaggatcagaaatgtcttttcatggtttgcaactacatggataaaattctgacttcttccatgcatgctgagaatcttcgcatcctcccagctttttccaagctttgccgcaagatagattacagatgaaatccccggaaaaatctgtacttcatatccgtcttttttcagaatatccgccagcttttttgccccgctgtaaaatccggtatccccggaaaacagcaccgtacatctggtcttttcctcctgctcatccaggattgctctgattttttccggcagatactctgcatagcagcatttctttttttcccggaatccttccagcatccgcgtagctccgatcagcacatcactttcctcaatgatctttctgacctcttccgtaagcgttcctttgcttcccatcccgatcccggcaagatttacctggcattttcggttttccacagttattcctccaatcgatagcctctcggtgtcaccattttcccatccacatttctcgtctggctgttgccgatataaacggttgtaaacatatcgacctccgtatccttcagctcagaaagtgtcagaatatgtgcatcttcgccttcacgtccgatgttccgcacataaccgcagactgtatccgggctctggtactccaggatatactcgcatgcctttttcaggtaatctgcccgtttccggctggacggattatacagacagatcacaaaatccgccatcgcagctccgcgaatcctcttttcaatcttctcccacggtgtcagaagatcactcagactgatcactgcaaaatcatgcatcagaggtgcaccaagaactgccgcaccgccatttgccgccgtgatccccggcacgacctccagctccacctccgggtagccctgtcccatctcatagagcagacctgccattccgtaaattccggcatccccactgcataccatagctaccgtacttcctttcatcgcctcatccattgccatctcacagcggatcacttcctgccgcattggtgtggaaaggtactttttatccggaaacctttcccgtatcagtcccgtatatacggtatacccgataataacctcacttttttccagtgccgtggacgcctggtatgtcatttctttctcagcacccggtccaagaccgattacatagacttttccaattttacacatttcctacaccttcttttcctttgccctgcctgaactctgttgtaaactccggatgatataaaagtgaccgttcatactctccgccaagcacctcaccaaccacgatcagtgctgtctttgtaattccattctcctttgctgtcaccgcaagatctttcaccttacatctgcacaccttttcatcctcccaggttgccttgtagacgatcgctgccggagtctccggctgataaccgccttcgatcagacgcttcgacagttcttccagcatcccggtacttaaaaagattaccatcgttgcctggtgcgcagcgaaactttcaatggattctttttccggaaccggtgttcttcctgccatccgtgtgatcaccacagactgtgaaatcccgggaagagtatattctgcattcagtgcagatgccgctccgcaaaaggagctgactcccgggcacactttataagaaatattctccttttccagcagatccatctgctctttgatcgcaccatacagacacggatcacccgtatgcagccggacaacttttttctcctgcttctctccggaaatcatcacttccatcacttcttccagcgtcatcttcgcactgttgtagatctgacagtccttctgacaattcttaagaagctccggatttaccagtgaaccggcatacaccactatatctgcttcctccaaaagcttctgcccccgtactgtgatcagatccacagcaccgcttcctgctccaacaaaatgaatcatttttctttctcctttgctattacaatcgaaaaatatcccgcatcttccggtatttcttctgtgcatttgtaaattttttctccatccattccgcagttcattaccattttcgcctgctgtccttcctctttcagaacagctttgacctgcgccatttttttcccggtcttcataagaaccttcgtccccggaagcttcaacttttcttcaattccataggacaccggaagaacatgcagctcgtgccggttctccacaagcgagatctccagccttgctgccgcagcacaaaaagacggaatcccggaaaaaatctccccctgatatcccatctttttcagtcttttataaatataaattcctgtcgaatacacggtcggatctccaatcgtcagaaaaaccagattctttcctttctccagaagctctgacgcctttcttgcacctgcatcgtgtatctctttcagtagcttttttcccttgatcattggcatgggaagatacagccgcagcttctttttcgtctccggctctgcctcacacgcaatccgatatgccagacattcttttgcaaatgtctcttcttccccctcttccagttccggtttctttaactccggactgccaattggaagtaccaatacctgacacgccttaatcgcacgaattgtctttatcgtcatcagttccggatctcccggacctacacccgcaaggtcaaatcttcctgccattttttgtcatacctttctacctatccgatcttttccctcagtttgtccacaagagatgtcttcccaagaaccccgagttcatccgaaaacatcagcgccccgaccttcatcttctcgccggcacgcttcgccaaatgatactcgatcttctccatcacggtccgcatcgtctcttccaaaagtcctctttcttccagaatgtccaatgcttccttcgtcgtaaaacacttcatcagagcacagactgtctcacggtctgcccctgccattgccgcatggacggcaagcacttccattcttgcatctgcctgtctggaatgggtattcattacacctgcagcgatcttgaccagctttccgatatgtcctacaagcaacagtccgtccatcttcagccgcacaccgtcatcaatcgcatccccgatataattgctgcatttcaccgcaagctcctggtcgtacccaagtgtctgccttaaaaaatcatttccataatttcccggtgtcagataacaataccggtgaccttcatcacgaagcatcttcatttccaggaaaatagtctgcgtcagtgcctgttcactcatcggttctacgattcctgaggttccgagtaccgaaatcccaccttcgatcccaagtcttggattaaacgttttcttcgcgatctccacgccctgcggaacatagaccagaacgtctgcgccaccatcccagtcatatttctcaatctggctttgcaccgcttcccggatcatctgccgcggaaccttattgatcgccgcttccccggcttcctgctccagcaccttccgggtgaaccgccctactccgatcccaccatctaaggtcactcctttttccctttttttcgtgaccttggcgtaaacgaagatcccgttcgtcacatccgggtcatctccgctgtccttctgaatggcacagctgacagattcattttctctttggatcttttctacttccagatacagttcgatccctttcggcgtcataagagatacctgacggatttcctccccggaaaagagcattgccgctgccgcctttgctgctgccgcagcacagcttcctgttgtatatccacaccgcagttctttttgatttttccacacgacctgcatcttgtccatttccatttcgtctccttagtattcgatgcctttccttgcccggattcctttttcaaaaggatgccgtaccatctttacttccgaaatataatctgccagctccagaagctcatctgacggatcccgtccggtcagaaccacttccagattgtccggtctgtcttttaagaactgcaccgcctctttattcgggatcagtccataccggtatgccgccataaattcatcaatcacaagcatatcataatcccctgtactgattttcccccggatcgtattccacagcctgccatacatctctcggacttcttcctgttccttttcggaaagtgtcttaaaaaatccatagcttttttccagatgaagtacctcgatctccgggatccgatccaggatcttcaattctcccgaaaattcattttttaaaaaacgggcaaacagaacccgcataccacttccagctgcgcgaactgcaagccccgttgccgccgtcgtctttccttttccatctccacagtaaatgtgcaaaagtctatttttcatatgattccagctttcccatttcttctgcaaatacaagcagttcttttatcttctggttggttgtcccaatcacaattcctgcatttatcacctttttacactgcctgatcatctgctttgcccgttcaaatgcacggtcgcttaccggttcaaatggctcttcttcgattacactgactgccagatgttctgccagatgatagtcaatatcattagtatacaggattcctgccgaaaatggaatctttgctttctgaaggttccggtaaacagggattccactgcctccggaagagatcacaaatacttctgcctctccctctgcctttgcaagctccacacttccgaacacaggatcaaaatgcccgttgtcgatctcataaagtttctggataaaatcttctttaaaaatcgcctccggctctccataaccgaaaattgtatctcctttaacgcacaggatcttatccgagatcttctgcgccagatcgatctcatgaagtgacataatgaccgtgatctgcttttctttcgccatatttttcaaaatagtaagcaactccagcttataacggatatccagaaaagaagtgggttcatccaggatcagtacctccggttcctggcagatcgctcttgccagaaggatccgctgtctctgcccgtcactgatcgcctcaaaacttttttctgcgtattctgttgcatggacaatttccagtgcttcctgtgtctttttctcatcttctcgcgttaatatcccgagccgtcctgtataaggataccgccctgctgctacgacctcatagcaggtcatcagctccggctttgcccgctgtgtcagcaccactgccatcttcgttgcaagctctttgtaagataagtctttcagattcttttcaccgatcgtcaccttacctccaatgagcgtaagctgtttggtaatactttttaaaatcgtagatttcccggaaccgtttggtccaatcagtgtcaatatctcaccttttttaatctctgtacagatatcatggatcagtacatttccatgatatccgacagaaagatctttcatctgaaaatagttctcactcatatttatttcccttttcttccttttatcatcatgaaaattacgatcggtgcaccaaagatcgaagtcacggtactgatattcagctccagtggtgcaaatgccatacgcgcgatcagatcacatcccatacagaacaccgccccgccaaggaatgttgccggtatcacaaccagcggttttgccgtcccgagaagatgcttgatcaagtacggaactgcgattccaacgaatgaaatcggtcctgcaaatgcggtcacacatgcggaaaatacactggaaagcagaatcagaagcacccggaacacacggatattgacccccatactctgcgcatacatttctcccagctgatacgctccgatcggctttgacaggaaaaaggtaaggatcagtgtgattcctaccataagcgctgctacctttacattgctccagctcataccggaaaagcttccctgtgaccagccatgcagattcacgatatctgaatcctccgcaaaagtcactacaaaatcagttactgccgagcagatataaccgatcatgattccgccaaccagaagagttgccatattccggatttttcttgcaagaagcaggataaatccaattgaaagcatagatccgataaatgctgcaatgatcagtatataagatgataccaaagtgtaatattttaaaaagatgatcatcgccagagcgaccatcatctttgcacccgaagaaatccccagtacatacggtcctgcgatcgggttggaaaaaaatgtctgcaataaaaatccggaaagggcaagtgcccctcccagaatccctgccatcaggacacgcggaagacggattttccagataatattcatctgcacctgtgttccttttttcagaaacaggatccgtaaaatctcaggaaccgagatctgtacatttccggtattgatgttcagcactacgatcatgcaaaaaactgctgccagcaccgcaaagactcccatatatcttgtattccttttccagttatttttcattcctgcctgtcccattttcttctccgttttctattttacatggtataaaaatgtcatcttgctttcatcgccgcctgtcagcatcagattcatatccgtgatcagttccccaacgatatcggttgcctgatacagatatttaccggtacaccatacatttccttctttgactgctttgaaatcagaaaaaagtgcatctttttcttccagatcttttacactgttgattggattatcgatacttgaattataaatcagataatctgcatccgccgcctgtgcgtaaaattcttccattgtaagttttactgctgaagtattactgtcatcgccagtcagatcatcgaatacatatcttccaccggaaagttcgatcattttcggaatataatcatcacttcttcttactaccaccgttccgtcactgcttacatagaaaaatgcaactgtcttctcggtattcttaaaatctttgagcgcatcgacattttccacctgcttttcaaaaaatgcatccgctgcatcttctttattcagcattgctgcataaagtttgatccattcagttcttcctagaggatgcgattcatagctggaccggtcgatcatcaccgggatatccagagattcaatcatctcctgtaccttcggtgtgtgaaggatcatggtcgattcgatggcaagatcacagtcttcgtccaccagcatctcataatccggttcactgtatttccctgcaaattttattttcccgtcatccatcgctttgactgcattttcaatataccatccggaagcctgggtacctgtcattgtgatattatccagagaatcgatcgcattaaaaagtgccattgcagatgtcgccgcaagataaatatgatccagcggctgctgaaggatcacgtaatcctcctcggctccatccggcacatcctgattttccgggacgaccagaaattttgcatcgtctttgatatcgatcatcttatagccgtctttgtagtaatatacctgaaaaccttcggcatattccagatccatcgcggattcataagtgagtccgtcaatctccggaccttttttttctttggcactttctttcgtactgctgctttctgttttttttgtatctgttgtattctttttcgtctgcccgcatccggtcagtgctgccgtcccaagcagcactgtactcaaaagaatgcaccccagacgcatcgttctctttttcattttctacctctgtatccaaaaaagaatctacctagttttttgcagaagaatctgtactgtctgtctgcgcgaaaattgcctcgtaaaccttgctccactctgcttttgcatcatccttttcctcatctgctgaccggtcaacgatcatcggaacatccagaagaacaaatttttctgccagctcttcgtatctcttctgctgatcttctaccgacattttcttctcattcttttcatccggaagaattttattggaaaggattgcaagatcacacttactcttcatcagttttttattttccggtttcttataggttcctgcataaatgatcttcttagctttcattgcttttgcaatgccttctaccttacagttcttctgttttacccctactgatgtaatctggtctgttgcattcagcttatccaggatttccagtacttcctctgaacctacatatgcagacttctttggcttctggatcacgatcatttctttatccagacctgccggaatttctgcgtcttccggaacgatcagataacggacgatctttgctttgtaaagcgcaagctgttcttcctgtgccggtgtcagtccggaatctgtatcttcttttgtatcctttgtcttggtctcttttgtatcctcatcttttctctgatcgatttctaaaagagtgattccctgatcataatgatagatcttgaagtacttagcatgctctacctttgtctcagactgataagaaagtcccatgatttccggcgctttctcatccagtgtatctgcacttaaattggtctccccacttactgtagttccgtctgcttttgctgcagcacttaggtaaatgaaaatcgaatagctgatttcatgcgctgttgacatcttggttgtcataccaatgatcgtattgttcttgttcagttctaccggaatgacaaatgtagacgtacttccggttgttgtcggataataggtatttccattcgcctttacatagccataagaaccactgctaaatacaatggtagcatatgcctgaccgcctgtcacggtaatcttggtacaactgatgctgacctttccggttccacctgaccaggaaaatttatccggtgtatagacaccgtctgcaagtgttgttgcactgtttacacgggcagttccaccatttaaatctgcctcatatttggattctttgtccggggtctggtttgtgcctgtgttgccggaagtggtgccagttccaaagttggtgttctggctggtgctatttccctggttggtgttgccattattgccatttgcaggaccgttactgcctggtttttttacacctgttgatgaaaatactaatgtacggtcataccatttattattttttttcgaatgtgcagccaccggaatttctgcatccagtgcatctaccggaattatataggtatacttaccattctcctcaacaaactttacccagttcgctgaatcggcagcagctttcgcactggttcctgcatacaaataatcatagccagttccactaagtgtaacctttgcagtcatctttccgttctttgatgtaagaacacaatctgtaactttaaacatagatgagcttgaagttacatttgccttataagttccatcttccgcttctacagccttagtcattccaattgtattaaaagttaatgtacggtcataccatttattattttttttcgaatgtgcagctatcgcaattcctttatctacactcgttaccttaactctatatacataccgtccaagtgcattctctttataacaactccactcttcctgttttgcttttccggctgcatcagctgttccggcatataaataatcgtaacctgtcccattaagtgtaatatctgcatacatttccccattagctgaaataagttcacaacttactacacggaacataggtgaactagaagtaacctcttttattgcatactttccaccaggtaaggtcttattagtactctcatcttctttctgattctcgccactttcggttcccggtttgctctctcctgaattgcctctctgttcaggattttctgtgtcgtcttttttattttctgctgacgatgagatatgaagcgtgtaatctccgtctgctttcctactctcccagccgttctcttggctatgtggtacaaaggcaacatccgttccatctgctgacagtggaagttcaaacgtaaataaataccctttgcctgttcccgttccaactatcgccttttcttctttccgttcaactgtatcagctttacttccaatataaattttattgtaagttttactctctgtttctatcgaaactttcaggtgatcattttcttttacaacagaagacggtccaaccttaaacattgcaaaatcactgataatatttttcgcttcctgcgtcttcacttccccggcattttccgccgtttcttccgacttaaccttctgctcctctgcagctttctcttcgctctttccgtcttcgcccgcttctttcttctctgcctcagttacattccctgttgccgcattttcttctgctttcggctcttcctgactcttctgattctcgtccgttccctgtccggcagtcgtttcttcttcctgtccagtcacttcttcagccggctgacctgctgcgtctgccgcaccgatttttccgtctgttacttctacagtctgctgacctgattctgtattttctactcctgccactgcactgtcctcagcgtaagcataagaaaccggtgtaaccgacattgcaattgccatgaaaagtgcaagaaactgttttgaattcctcttcataatccaactcttcctcctgatgtcctgatcttttgtcgcttgacagctcgatgatgtacattcgccaaattcagttcctcatgcaagcataaatctgcacttggctcatcgtatgcaaaaaaatctgcttcctttttcctgaaagcagacttcacctacatcctctgccaccggaactcttttccgtatatatggcagcacaaaaatcttgctttcatactcagtatgaagcaagatatcatttctttgtgtatgtaaacgcgctttcatcggaagcaatttactctctttcagcaggtctcctggcttatggatcttaacaaagctgcaccttctcacatttttatgcaatggcttgccgccgctttgctcctcatttacagtgaccggatcgctcaggactttcacctgattcccttttaagccgaccagaaattcttctgcctagcactgaaaaagtttctttatttattcttactcactataacagatatgtttcttcttgacaagagtcatctttcctggtttatttccctattttttccaaactctccattaaaaatcccggaagtttttgtttcaaaatcgacaccttaatgactatatgtttatcataatttcatgacctacttcatttatatatagaaagcgaaggggatcgaaatgagaaaaaagtgccagtgaatgtatggaaatactctgaaataagacaatgcagccgccagatcgacgactgcattgtcttatactctttttcgtacaattttattttttcgctgcctcaaaattacgatgaagtaattcgtgggtctttcctttcagaagttcatcatataatgacaggatcagcggattctcattcgacttcttaatctgcgtattgatatcggtatcatacaggcctttgcttctggctatcctgcttctcggacctgccgggactggctgtccgccacccatgatacatccgcgcctgcatgccataacctcaacaaagtcgtaatgtacctcgcccttctggatcttcttcatcagcgcatctgcatttccaagtccactgacaacagctgcatggatagtacgtccgttgtaatcaaactctacttctttcagtccttcttctccacgaactccactgaatttgatcttatccatttccacacggttatgtccttcacgaaggcgcctgagtacggcttctgtcacaccaccggttactccgaagatcacacctgcaccagatccgataccaaacggcatatcggatgcttcgatctccagattttcaaagcggataccggatttccggatcattgtaatcagctctgttgtagtcagtacataatcaatatcctgttttccattcgtggaagattccggtcttaaaatctcttctttctttgcagtacacggcatgatcgatacagaaacgattctctttccaccattcttttccggatccttatagtattcacggatcacagcaccaaacatctgctgcggtgaacggcaggttgacagattttttgccagatccggataacggttctcacagaattttacccatgccggacagcaggatgtaaataatgggagattttctccggatgcaagtcgttcaagaagctcttcagattcctcgatcaccgtaaggtctgcaccataagaagtatcataaacttcatcaaatccaaggcggtgcaacacattgacgagttttcccatcacattttcccctcttggaaggccgaactgatcgccgactgcgacccggactgccggtgcgatctgtgcgatcacctttgtattcttatctgcaagaaaatcccagatcacttcgatattggtattgatactgatcgcacctgtaggacagacaaccctgcactgtccacagtttacgcagtctgtctctgcaatctttttgttaaatgccggtgttaccagagcctttgttccccggtatgcaaaatcaatcgcattaacagactgtacattgtcgcacatacggacacagtcaccacagagaatacatttattcgggtcacgcacgattgacggtgaactgaaatccagtggatactgttcttttgtattttcaaatcggacggttgtgacgcccatacggtgtgccagcgcctgaagctgacattctccactcttgatacaggttgtacagtctctgcaatgtgcagcaagtaaaagctccagaatcatcttacgatatttcataagacgcggagtattcgtgtaaatgaccatcccatctcttggcggttctgaacaggatgcaaacgtctttcctctctcatcttctacggtacacaaacgacaggctccatacacagacagttctgaatggtagcagagtgtcggtatatctatatctgcattacggatgacagaaagtacattcggctcatctgtaaactctaccttccttccatctattgtcatatatcccatgactcattcctcctatttctcgatatgaattgctttaaacggacactgttccatgcaggctccgcacttgatacatttctcctgattgatatgataaggagatttcagcacgccttcaattgcacctgccggacagtttcttgcacacttcgagcagcccttgcatatctccggatcgatctggaatttacgcagatttgaacagacacctgtccggcagcgtttctcgttgatatgttccagatattcctcttcaaatgcattcatggtactgataaccggtttcggtgcgctctttccaagtccgcaaagcgccgtactctcaatcatatctgccagttcacgaagctcgtccatatcggacggttttccgtttcctgctacaatacgctccaggatttcaagcattctctttgtaccttcacggcaaggaacacattttccacagctttctctctgtgtaaaactcatgaagaatctggcaacctctaccatacaggtatcctcgtccatgataaccagaccgcccgaaccgatcattgccccgatcttcgccagtgaatcaaagtccatcttactgtccagctgatcctcggtcagacatccaccggacggaccaccgatctgtactgctttgaatttcttgtcattctggattccaccgccgatgtcataaataacttcgcgcaatgtaattcccattggtacttcgatcagtcctgtatttcttacattaccggtcagtgcaaatgctttcgttccgggactttctggtgtaccgattcctttgaaccagtctgcaccatttgttacgatcatcggaacattggcataggtttctacgttattaagaacagttggtcttgcccataatccctgctctactgtacgtggcggttttactctcggcattccacgttttccttcaatggatgccgtcagtgcgctgccttctccacagacgaatgcacctgcaccacggttgatatgtaaatggaaactgaaattggttccaagaatgttgtctcctaaaagtccgattgcctctgcctggctgatcgctgtcttcagtctttcaatcgcaagcggatattctgcacgtacatagatatagccttcctgtgcctgtactgcatatgctgcgatcatcatgccctcgatcatacggtgcggatcaccttccatgatacttcgatccataaatgcacccggatcaccttcatcaccattgcagaccacatagcggatcttttctttctgggaagcaacctgctgccactttctgccggtgcggaatccagcacctccacgtccacgcagattcgaatcatagattgtctggatcactgcttccggtgtcatctcaaagagtgccttttcgattccggcataagcaccgactgcaagtgcacccccaatatgctctgcgtcgatatgtccgcaattcttcagtaccagtctggtctgctttgcgtagaacggaatctcttcctgtgacggataggtcactccatccatcttgtagagaagtcgctctaccggtctgccgcccaggattgtttcgttataaatctcttcgcagtcttccagttttactttaatatataaataattatatggctcaattcttaccagaggtcccatctcgcagaagccatgacatccactcttcataacctttgtatgtgcgatttcttccccgatctttacttctacccctgtatgatcttttgtcagttcttttaacttttcataaatcttgcctgatccacttgccagacatccggttcctccgcaaaccagtactctgcagtcagccgattgttttttctgacattcaatacgatattccttcagttccgttctgttttcaattttcattttcttcacctctcagttcttcaagaagtttgattaccttctccggtgacatcttcggatgtacttcatcattaactgtgatcgcaggtgcaagtccacaggctccaagacaggatacagtctctactgtaaaaagcatatcgtctgatgtatgcttgtgctcatttaaccccagctctttatacagcgcttccaggataggaatggatttacgcacatgacaggctgttccgtcacagaccttgatcacatactttcctttcggttcaaatgaaaaattctcataaaagcttgccacactgtacgcttttgcctctgtaatcccgatctgttttgctacataggtaagcagttccggtggaagataacggtattcctcctgaatatcctgaatgatcggtatcaatgagcgttcctcccttgtatgcatggcaatgatctcatccgttttctgataataagatgcatctaacattccatttcctccttcgtcatattgtacatttccttcttattattctattatttttatgacattataacatatatctatagttttcgtttatacgtttcatatatgatagctatatattttccaatatataataatacaagaatcaaaagtattagtatttatgaatagacggataaatgtgtacccagctcatcaaatacacaaaaagagcagaatggatatatcttggtccgatatatcattctgctctcatttacatcatttcacggattgtttcttttaaatgcccaataaattctctttcgtacaattttttctgataaccctttttgtagatcagcacatcccggatcatctgtctggaaaatccggcatgcttctgcaccagattgtagtttttccttaatttttccggtactggcgatacccacatataactgttttttacttcccgcaaaatatcaaactggcttcccctttcaaaaatataaattttattatgtggatgaagcgactctccattctcactcagctcggtgtattctccggtcggaagtttccagtccccatgcaggatttccacaccatcttccagttcttctcttatctttaactccctctttgcaagatctccatccgcagaagttaagatcacatacggaagctctgccagaagttctgcatccagccctttcagatcaagaagcgactgaaaataaggttcattctcgcacagataccggatgattcccatggaatacccgttctgcaacacattttcaatggcatgcatagaactgctttcctgaaattctgctttgatcgccgtttccttgctctgcattccgataaactctgcaaatgcactggaaatgtaacttgccctcggaacagtaatcttaaatgagagattttctttccccagatcactgcagtcccttttcatttcctctatttcgtaaatgatccttttggcatactccagaaatttctgtccttctcttgtcgccttaactccctttgacgaccgctcaaagatagaaattccaaattcccgctccagatgcttgatcgctttactaagatttggctgcgccacataaagttccttcgccgcctttgagattgatccactcttatcgatttcaactacataatgcaaatctgtcagattcatcttccccatctgcctttctgatctctgactttatctccccataactattttctgaacttttattacagattcttttccagccatttacagacttctgaaaatgttctccctgtttcttttggtcttcctaccgcaacaagaactgcccctgtttcctttgctgcctgtaccttttctccaaagcctccggcttttcccgattctttggtcacaaaatattttgcgcctgtctgatggatcgtagccacgttcatctcctttgaaaatggtccctgcattgcaatgagatgctttccttcaaatccaagcgcgaccgactccataaccgcctgctccgtagagaggactcgcgcaaagcagcgctctttatactccgtaagctttgtatattttatcagttccttgctaccggtggtaatcagaatctttccttctgtattttgcagatattccaccgcatcttcaaccgactgcgcccagatcacccgatccgcttcatccggcactgcttccatctcctcccgcaggcaacgcagatactgcacaccggagatttcgcaggccctccttatctccccagtcacaagctgtgcaaatggatgggttgcatcgatcaccagatcaatctgcttttcctttatcatctctgccatctgcttctgatccatacgtccaaaaaagacttccgcattctcatgctctccggtacattcttttccatattcggttgcggcactgacataaacttttacatttcttccatccagaaattccgtaatccgccttccctctgttgtccctgaaaatattaaaatccgcttcatattctgatccttaccttcttttctgccactgctattgtcacccgattcatgcactgcttcggcatcagaagcctgccatcctctccggctgcaaggatcgccgcccgctcacagacattgtccacacccgtgaccttccggacaaactccgaatgggagctgacacatttaacctttcccaactcttctgctgaaaacgtgtaaaatggaagcttccactttgccgcataagaaagtaatccctcctcttcttttttcagatcaatactgtcgatctcaatgacttccttttctgtaaatccaaggatcttttttgcctcattgaccgcgctttggatttcttcttcggaaatccctttgcgacatccgattcccagcaccaagttcttcggcggaagatccagaatcgtctcttcttcccgcctttcaccacttcttcctgcaatccggattccatatggatagtttctgagaaactcttctgtttcacatagctttaattcctccggaaactttccttctattggaaatacactgtaaagtccaatcttattcccatccagaaccacagctgagatctcctttgcttttttccggtctgtcagtaccagaccattgctttttgcaaatacatctactgcaaacttttgttctacatccgttgctgtagtaagtactgcctgcgcatttattttctccgcaatttcctttgcaagctctacagctccgcccacatgtcccgacaggagcggaatcacatagcttcctttttcatccatcaccagaaccggcgaatcggtaaatttgtccttcacgtgaggggcgatcatccgcactgcgattcctgccgccccgataaaaaacaaagccttctctccccagaggctgcctatccagcttttcttatcttccggaaaagcatgaaatccgtataatctgcaaaaccgtgtcaaagtatacactttgacacggtatccgctttgtatgaaattctctctgactttacaggccatctgacaacctgcatctgtaaaactcaagattacaatttccataaactttagtatttctccatctgctccacgttcagtacaaaaatcgtacttccgcctacctgcacattgatcggaacggacggtgctgcgctcatgctgctctgtcctgagatcaatgccgggtttgcataagtgatcgtctttctttcgccagaattcttcttgatgatcttcagtgcctctgctaccttctcatcatccactacaaccatgatcgtggtactctttttcttcagaaatccaccagttgtagccagctttgttaccatgtatccggcaatattcagttcctctatcgtctccagttcatcatccttatgcaggatcgccataatcatcttcatacaaaaaccctcctgtcttatctggcttttgatgccagattcctttttcttttattttaccgcatttacctggaaaggtaaacgaaaatgttgcattttaaaagattttaaaagattagttgaaatccaaaacgaactttaactttgtgcattacctattacaataatcttcttcaatcctgccatccagtatccggatcacccggtgtgcctgactggcaatctcttcatcatgtgtgatgataataaccgttcttcctgacctgtgcagttctttcaggatttccatgatctcctgtgttgattttgtatccagattgccggtcggttcatcggcaagaatgatcggcggttttgcggcaaccgctcttgccaccgcaactctctgctgctgtcctccggacatttcattcggcttatgcttcatccggtcttccagaccgacacttttcagggcttccatcgcaagttgctttctctcattttttgacaccccgcggtataccagcggaagctctacgtttccaactgcatccagattactgatcaggttgaatccctggaaaatgaaaccgatctctttattccgcacatctgcaagctgattatctgtcatactcgccacatcctgcccgtccagaacatacttgcctgaagtcggtgtatccagacagccgagcatattcatcagcgttgattttcccgagcccgaatgtcccacaatcgcaaccaggtctcctttttcgatatccagatcgatcccgtcaagtgcacggacttcattctcacccggattgtagattttcttcatattttctatatgaatcaatgcccccataaatgttctccttttcttttcgctctactttacgttcctgttttcaatataccttattttgaatccaatcacaatgctatcctcctggcatcatgaattcttaagaatttctattgaaaacatctttaaatttccttctttataaaaaatatcaattatacatctcgtttaaaaacacttatgataaaactatcatttataaaaaaggagatctgaaaatgaccaatttaaaattaccggaagattttgaaacctatccggaagcaagaaagaatgcttttctgaaaatgaaagagctgaaggagtccgggcgcagaattgtcggagttttctgtacctacaccccatgggaactgattgaagctgcagacgcagctgcagttgtactttgcgggatcggagatgacaatatcccgatcgcagagaccagactgccacagaacctttgtcctctgatcaaggcaagctacggtgccgccctcgctgaccgctgtccattcttctatttttcggacatggtactcgcagagacaacctgcgatggaaaaaagaaaatgtatgaactgatgtccgagcttaagcactgccatattatgcagcttccgccaggaaaaacaggccgcggtgcgctggaattctggaaacaggaggtaatcagcgtcaaagaagatctggaggatttctatcacataaggatcacagatgagcagatccgcaaagcaatccatcttcgcaaccgggaacgcaaggccgtccttgacttctttgagattggacgcttaaaaccgactccgattaccggttatgagatcaacacggttatttcctcgaacgaattcacggttgatctggaagaaaaaatcaaatacctggaacaccgtaccgctgagcttaaagagctttatgaaaaggaatataaaggcaaaccatcccgtccgagagttctcattaccggatgtccgaccaccggcgtgatcgacaaaattgtacgccagattgaagaactcggagcagatgttgtcggctttgagaactgttgcggtccacgtgagaaaaaagatccgattgatgagacaaaggatccaatcactgcaatcgccgaaaaatatcttcgtgtaaactgttcggtcatgagtccgaacccgggacgtctcgaggcgcttgatgcccagattgatgaatatcaggtagatggtgtcgttgaggtccttctgcaggcatgtcatacctttgccattgagtccgatgcgatccgcacctttgtcaccaaagaaaaaggacttccgtatcttgcgatcaatacagactattcttctggtgaccaggcacagatcaatacaagactcggggcatttatcgaaatgctcggttaaaagaaaatccggtgatctttccttcgatcaccggacttcttttttctctttttggcagaatcatttaagcttcttctttcccttcaacaaggctgttcagcttcttgttagccaagaagataagtgctgtaaatactaacataatgactgtgattccaacaaatacagggaacacatcaaatttttcaataaatgcctgtacaaacgggcttaacttgtttgcgccaaatgtagaaattgcgataacccccatcaaaagtgagagatatttcttcggcgcatacttacttacaaatgcattacgcagcggtgagaaacacatctctccgattgtaataaccgttacaaacaggaatggccagaaaacgcttgcttttacagaagcatctacgccaactccgcgaaccagttcacaaacaaccattactccaaacgcaagtcctacaaaaaggaagccaagtgctactttcttaaacatattcatatcgccctgcggacgctcggcaagtttcttccagatggctgccatcacaccaccaagaacgacacacaaaagtccgttccatgtagtagtaacccatgacggcggaatgtcaaaagagccaatactcatcttcacataatcggtcatataaatgacaagcgcaagatcctgctgatagtagaacagccagaagataacagagagtgccgatacaagaatgatcgctatcatacggtttctttccaattttgtaagcggctgcttgtcgttcttcccatcttctttcttttcgttagacccgatcacatttccattctcatccgtaagatacttgaatggtttcacaccctgtccctgaaggtttttccagttcagcacaaaccatgccagaccaacgatgcaccagatcgatgccacaaagaagcactgacggaatccaagcacatcgccttttttaaataagtggagatacaaaaatccggtaagcagtgaacctacgaaagccccaacatttacataagaatactgaatggaaaatgcagcatccagaagctctttgttctgatattgtcttccgatcagagcgtttaagtttcctttgaaaagaccggttccaatcgatacaagaatgatcatcagattgaccattcccggacctgttgccttccagcctaccagatatccgattgccatgataatatatcccagagagatcgcatatctcgctcccagccatctgtcagagataattcctccgatcagcggtgccatataggtgtacgctgtcagattcgctgccatgactgccgcatctgttcgctcaataccaagaccaccctgtaaagttgcagtgatcaggaatagaagcaagattggctttgctccgtaaaatgccaggcgttcaaacataaatgtgatacaacaggcataaaagccttttggatgtttttcattagtctgtgcttttcccattactttttatttcctttctgttttggcgactgtcgacaatcgtcatcctttataagtaatatagcataacttcaccactttttcaatacagctcatgtcttacactctttttttgttataattcaacaaaacacagcaaaaaaagatgtggaatattactatccacatctcttcattattaatatttatccatttactactatctaaagactgtaacctctctctgtatcctagacaagaaaatcaaatgaaaatccggaatcctcttccgacaatccctgctctttcaaaagccttcggatcgttctcatgtaatgttcggaaagaacgtgacagattttctccttgttcttttccctgcaggcatccaccagttctttatgaatcggatactgtctttctaacacacgctttttatccgtgctcaggctgaagcccgtaacaatatttccataattcagctctttccatgctttatagagccttgtcataccagtcatctctacaagcagtccatgcatctggttatcatagacaaaaacctggtcaaactgctcttcatccagttttttcattttttccagcacttcttccatccggcaaatggtatcctctggaacgtttcctcccatcagcttcactgccatggtttcgtaattcgcccgcataaggtaaatttcaaatgattcttccagtgtaatttcttttacagagcatcctgcatttcttacatattctataagtccttcattttccagctgtctaagtgcctcacgaatcggagccctgcttgtcttaaattcctttgccagatcctgttccacaatcttctgtcccggctccagctcctggtaaatgatcctcttccggataatatctgcaatattttctcttagtgttcgatatattaattctgccattccttttacccaaccttgttactcattctctgccatttcggtgatctgacaccataattattataacaggacagtttctttcctgtctataaaaaaattagaatgcactctgaattttatttttctatcgttcctcgaaatacgccttcttccagattcggaaaaacttgcagagagttcttccggaactctctgcaaatacttctttatgcaatttcaaacaaaccatcgcctgctgccttgatatgacagctgtaaaattctttggatgcctcgatcagataaccggtatcctttacaccggaagtctcataagccgaatgcattgcgagctgcggaagtccgatatccacggtattcatggatacctgcgccattgcaatatttcccagtgtacttccacctgccgcatccgaacggttggcaaaaaactgcaccggtacacctgccttttcacagattgccttgaaaatcgcaatacttactgcatcactggtatatttctgaccggcatgagatttgatcacgattccttcgttcatatagttacagttatttacatctgtcttctgctgataattcgggtgtactgcatgtgcattatcacagctcagcataaaacttccggcaactgcacgatagaaatcttcctcatcctttcccagtgccttgttgatccgccaaagcacatccgacaacagtgtcgatgctgctccctgcttggttcctgatccaacctcttcattgtcaaagcaggcaaaaacattgatattctttgcattttctcctgcaaggaaaccattcagcgacgcaaacgcacactgcagatcatccagctgtggacaggataagaattcattctctcttccccatacagatggctccattcggttatacaggaacagatccataccataaatcttctcttcttctacgccaatctcttctgcgatcagttttttcatctcacccggttcttttgccgatccagcaaaaaccggaagcatgtctacctgtttgttgatcgcacggccttcattgactgcgcggtccatatggattgcaagacttggaatcatcagaagatctctttctaccttgaccagtctggtctccattccactgtccgtctttacaattacgcgccctgctaccgataacggacggtcaaaccaggtagagcagatcattccgccatagccttctgtattcagaaccgtgtattttttcttcacctcaatctctgcattctctttgatcttaaaggtcggtgagtcactgtgggacgcagttacatgaaagctgtactcatccagttggtttccgactttaaatgcaagaatgctggaatggttgcgggtcacataatattttccgcctttttctattttccatttttccgattctttcagctcctgaaatccttcttttgtaagaatatcccggattgattttactgcatgaaaagcagtcggcgagttctttataaatgatgtgagttctttaattgtctggttctccataatgttcctcctggcatttcagcccctttattttccagattcttttgcacgttcacactcggcaagcttcagcatgataattccaagtgcagtcagcactaccggtgtgatcacattcattgcaaaggtaaatggatttttgttatacattcccattatacaacagatcagtgtcacaaaaaacaccatcctccaaaaaagtatgcgatcttctgatttttcacaaaacggtattctgccggaatccggtcaatacatttcctttaattctactaaattcccctttattctgcaaactgtctaatgatgtcttttacaataaggactgctttatccattccttctaccgtgatatgctcaaatacgccatggaatgcatgtccgcccgttccaagattcggacacggaagtcctttgaagctgagtcttgcaccgtctgttcccccacggaccggtgacacgattggtgtaatacctgcatgctcaatcgctgcttttgcgtaatcgatcagctgcatgcacggttcaatcttttcgcgcatgttgtaataagattctacaatctcaacttccacttttccttcgccgtactttttattcatctcttctgcgatatcacgaagtttctgtgctcttgcgtcaaaagatctgcgatcaaaatcacggataaagtatttcatcttagtcgttgtcacatttccctgcacgctgaccagatgatagaatccttcatatccttcggttgtctccggtctttcatttaccggaagcatctggtggatctcggttgcaatggtctgtgaattaaccatcacgtcttttgctgatcccgtatgtacgctgacaccgtgaatggtgataaatgcagtcgatgcattgaaattctcgaactgaatctcgccttcctcatcaccgtccaaagtgtaagcatagtcagcaccaaaaccttccacatcaaaatgctttgctcctcttgcaatctcttcatccggtgtaaatccgatgcagatctttccatgcggaagtccttctttgatgatctcttctgccacggtaagaatctctgcgattcccgccttgtcatctgccccaagaagtgtggttccgtcagttgtgatcagagttctgccctttaattctgcaaggtacgggaactcatctactttcagaatatctccggaacctttcaggacaacgtccttcccgtcataattctcaatgatctgtggctttatattttcccctgatgcatctgccacagtgtccatatgcgcaaccagaccaagcgacggcttgtcttcgcatccaggagttgcagggatgtgtccatatacatatcccttgtcgtccactcttgcatctgcaattccaagacctttcatctcttctacaagcattcttgccagtaccagctctctgtctgctgacgggacagtatcgcttgtctcatcactggttgtccataccggaacgtagtttaaaaatctttcgtaagctctcatattgttaggttctcctttgcttttcttagtttcattttattacataaattgtcggatgtacattggcgaatgtcgacaatttatggggttttattttgtttaatattttcgccaaaataaaagtttttcactttttcaggtgttgtatgtttccatttgtgatagtttttcggttctactttttcttaatattgtagatttttctacagcataagttcgtggtaaacttcgccgtataggtttttccatttggcgagaccgtcttccaggatcatgtagctgtgggcgctgttttcttttgggatggaaacggagcctggatttaagtagaggttctcgtttccgaatggttcccaggccggtacgtgggtgtgaccgtgtaggagaatatcgcctggctgcattgggattggggtcatgacgttatgatggtgtccatgggtggcgtaaatgatcctgttaccgcacgggatcactgcataatctgccatgatcggaaaatccagtaccatctggtctacctctgtgtcacagtttccgcgtacacagaataatttctctttgacttcatttaacattttgattacctttttgggttcgtattccagcggaagatcatttcttggtccatgatacaggatgtcgcccagaagtaacagtctgtccggacattcttttttcatcgcatccagcatttccagacaataatatgcggatccgtgaatatctgatgcaatcattagtttcataacgttcgtctccttttcttctatctttttggtaaatatttctgtttctgtaaatctttcataattataaatagggggattgcgtagcaatggaaatggagcaatctggtatcatcataaatattctgccgtgacagatttctcactcattttcatctcagacggtgtaccggcaaacagcagtcttcctccggcatctcctccttctggtcctaattctaccacataatcagcggatttgataaattctatgttatgttcgataacaaaaatggaatttccttcatccaccatctggttcagaagctttaacagactccggacattcttgatatgcaatccgtttgtcggctcatcaagaatgaaaatacggtctttacttccgagataggaagcaaacttcattcgctgcaactctccgccggataaagtagaaagtgcctgattcaggtgcagataagaaagtcctactttttccagaggctccagcgcttcgctgatctttgttcccctgaagaattcccctgcctgtgcaacagtcagatccatcacttccgcaatattctttccatctacttcgtattgcaaaacttcttttgaataccgcagtcctttacacacatcacaggtcgtctcgatgtcatccataaatgccatatccgatacgatcactccttttcccttacatgccggacactttcctgcgccgttaaaagaaaacaaagatgccttctgaccgcaccgctttgcaaatattttccggatttcatctgcgactcccagataggtcgccggagtggatctgagacttgcacctgcagcgcgctggcttacaaacaccacatcctctcccatactgcggtaaaagctttccatcagagaactttttccggatccggcaacaccagcgatcacaaccagatttcctattggaaattcgatggtaatgtccttcagattgtgaagatggatatgctccatccgccatattcctttcgcttcccttgcctttgcttttagagaagtagtaagccgcatctcttctccagtcggcgtatcactctctaaaagttccttataactgccttcaaataaaactcttccaccggccattcccggttccggacccatttccacaatgtgatcggccatctcgatcattttccggtgatgctccaccagaacaaccgtatttccaccatctctcaatttttccagtgcacggcgcatccgctcaatatcatgattatgaagccctgcactcggttcatccagaatatacaacaaatcagaaagcgaggaattcaggcattttgcaatcttgcatctctgaatctctccaccagataaagtagataaccctctgtccagagacagatatcccagtccgatatctataagtgcagacagtttggtatgcagtgtatcctgaatatcttttgcaagcggatcttctatttgagcaatccacgcacgcagctcggataatggaagttttattacatcagcaatatttttcccgtcaattttgcaggacaacaccttctgattcaatcttgccccattacactccggacaaactccatgactggtgatcggatccaataactccctgtgaagttttccttcttccgaatttaggacactgcggtacatccgatgcacaaggccttcgtatttcgcagttttcggccatccttccggtggattcttaagacgtatctgcggtgaatacaaaaacagttccaattcttcttcggaatagtctttaatcttcttattcagatcaaacaatccactgtttgcatagcggatccatctccactgccccggctcaaatgccacataatggatcaccccgtcatcattcaaacatttatcaaaatccaccagcttatgcacatccagatctgtcacttctccaagtccgttacaccgcaggcagcatccctgtggatgattgaatgaaaagctgtccgaataaccgacaaaaggctgtcccactctggaaaataaaagcctcagaagggtataggtatccgtataagttccaaccgtcgaccgctgattcggcgacggctttttctgattgattacaattgctgccggtagattctcaatccgttctacatgcggtcttccgtatttgggaagatattgctgcacaaaactcgggaaagtatcatttaattccctgcgtgactgcgccgcaagagtatccagaaccagcgaagatttcccagaacctgatactccggtaaatactgtgatctgatgctttggtatccggatggatacatttttcaggttattctccgtcgcatggtgaacaataatctcatttgtttccatatatttatattcctctgttttactctttctacagtaatttctgtatttcttattgtatctttatcaaaaaagaaagtaaatagcaagttttggttgactttagtatggtagattgataatatagtgacgtgacattttttgaaattatatgaggagagattattatgaaaaaaataacagcacttgcacttacttcagcaatggtattatcccttgcagcatgcggaggttcatcttccgatacaaaaacttcagatgattcaaaaaaagcatccaaaagcgatgtagaatacgttcaggacaaaggaaccctggtagttggaatcaccgattttgagccaatggattacaaaaatgataaggatgaatggattggttttgatgccgacatggcaaaagcatttgcaaaaagccttggcgtagatgccgaatttgtcgagatcgactgggacaataaagtcatggagctggatggaaaaaccatcgactgcgtatggaatggtatgacacttactgatgaagtaaccagcgcaatggcatgcacctccgcttactgtaacaatgcgcaggtagtggttgttccttctgataaagcagacaaatatcaggacaaagacagtctgaaggatctttcttttgcagttgaatccggaagtgccggagaaaaagctgtaagcggagaaggatatgactacactgcggtttcttcacagtctgatgccctgatggaagttgcagccggaacctctgatgcagcagtcatcgaccttctgatggccggtgctatggtcggaaaaggtaccggatacgaaaatctgactcataccgttgagcttactaccgaaaaatatggtgttggattccgcaaaggttctgaccttgcagacaaactgaacgaattcttcaagacaagctacaatgatggttctatgaagaaatgcgctgaaacctatggggttcaggatgccatcattgagcagaaataatatttaaggcaggaactttttatgaatctgattatgaaacaaatgccggtcgtagtgtccgcactgaatgtcggctttttacaaactttaaaattatttattgtgacgctggtcggcgcccttcctctcggactggtcattgcctttggctccatgtctcattttaagcctcttagctggcttgcgagactgatcgtctgggtgatccgtggtaccccgctgatgatccagcttctgatcatctactatttccccgggctggtcttacataacccgatctggggtggtggtgaaacaggacgattccttgcagcagccgtatcttttatcatcaattacgcctgttatttttcagaaatctaccgcggtggaatccagggtgttccggaaggtcagaaagaagccggtcttgtacttggcatgacaaagcatcagatctttttcaagatcacactccttcagatgatcaaacgcatcgtaccaccgatgtcaaatgagatcatcaccctggtaaaagatacttctcttgcacgtattatcgcgctgcaggagatcatctgggcaggacaggcatttatgaaaggctcacatggcatctccggtgccatctggccgctgttctttaccgctgtttattatcttattttcaatggtatcctgaccgttcttctcggacgccttgaaaagaaactggaatatttcagataaggagaattcatatttatgccaatcttagaagtagaacatatcagtaaatcttttaataagactcctgtcttaaaagacgttggatttaacctagaaaaaggacaggctgtttccatcatcggatcttccggaagtggaaagacaacgcttctccgctgcctgaactttctggaacatccggataacggaattatccgggtaaatggcgaaacactttttgatgcctctgtcccggcaaccactcaggaatccgtgatccgtaaaaaacgactgcattttggtctggtgttccagaactttaatctgtttccgcagtataccgctctggaaaatgtaatgcttgccaaaaagcttctcgccgcagagcagccggattttaaagaaagaaaacgtgaaattctgaccgccatcgaggtacaggcaaaggttcttctgacacagatggggttggataaccggatggacaattatccgcatcagctttctggcggacaatgccagcgagttgctattgcaagggcacttgccctgcaaccggacatcctctgttttgatgagccgacttctgcactggatccggaactgaccggagaagtattaaaagttatccgcgagcttgccgaccagaatacgacgatgatcattgtaacccatgagatggcatttgcacgcgacgttgccgatcatgtgatctttatggacgacggacgcatcgttgaacagggtgatccgcgtcagatgtttgaaaatccaagtgaagagagaacaaaacagtttctttcgcggtttcatgaaggataagctgttagatgaagaagaggacttgtaaggttttagtcttacaagtcctcttgaaattttatctattacatttttccatttgtggatagcattctttcgcaaactttttgttatcccaatagcatggtttttgaggtgtcttataaagatcgcattcactacatctgtttattgtctttttgtccttttcctaacttcacctgctttcccattttcattgactttccctctgccgcaccttatacttaaaagtaatgacttaagaaacgagggaaatattctatgtcaaaatcttcagccaaactgatgaccgaaggctccatctggaagcgtatcgttgcttttgcgatcccgcttttctggggaaacctttttcagcagctatataacaccgccgactctctgatcgttggaaattttcttggaagctctgcgcttgccgctgtcagctcttccggtaatctgatctttcttatggtcggtctttttaatggaatcgccatcggatccggtgtcatcgtcgccaaatattacggtgccagagacattgcgaatctacagaaatccatccatacaaccgttggtttcggactgatctgcggcgtgatccttaccattgtcggtatcattgccgcaccacagatcctggtacttatgggaacaccggaggcggtacttccaaactcgattacttatttccggatctactttaccggctcacttgcctttgtcatgtacaacttctttgtcggcattctgcagtccgtcggtgacagtacccatcctctgatctacttaatcgtttcttcggtaacgaatatcattcttgaccttgtactgatcgcaggtcttggatttggagtaggtgctgccgcttttgcaactgtcatttcacagtttttaagtgctatcctctgtatggtgcagctgcttcacagtccggaggagtttcggcttcatctgaaccggatcaatctggattcttatatgctccgccagatcatttcttatggtctgcccgcaggactccagaactcgatcatttctctggcaaatgtattcgtccaggcaaatataaaccagtttggggaaatggcggttgccggatgtggttcttatatgaagatccagggatttggattccttccgatcacctgttttgcactggcacttactacttttatcagtcagaatctgggtgcaaaagagtatgagcgtgctaaaaagggcgctgtattcggtgtgatctgttcccttacgatctctgagctgatcggtatctgcgtgcattttaccgctccacagcttctatctgctttcagttccaccgcagaggttatccgctacggagccatgcaggctcatacggatacctttttctacttcctgcttgctttttcacactgtatggcaggaatcatgcgcggagccggtaaatccacagtcccgatgtatgttatgctggtatgctggtgtctgatccgcgtttcttatatcgtgatcattttaaaattcatcccgtccattcagatgatcttctgggcttacccgatgacctgggcgctcagttccattgcttttctgatttatttcctaaagtcagactggatacacggactggaaagataaattccacaaatttatacttgactcatcgtatacaaaaaaccattacaggatctgatgaaatcacatctctcctgcaatggttttcttttatcctaacccacatacagtttctcactgctgtatccgttttatttccattatttatccattcatatttccgtttcgtcaagaatacggaaatgtttcctgtctacttcgatcagcctgtctttctgcatcttcccaagctcatttgacatcgcggacctgtctacattcagataatctgcaagctgctgccggttaaacgggatatcaaattctttcttcccgttttccatagcctgataagacaaatacgacagcagtcttccccggatcgattttgatgaaatatgaaaaatccgtttcgacagacggagattcttctctgcggaaagcttcagcagattttcaattaacgtatgatgaaacacacacgaattggaacagactttcagtatccttcccacatcaagaaacaaaattcttgcctcttctgccgcaactacattgaccatcagcttctgcccaggaatcgctgcatatgtttctgcaaaaatctcgcctcttccagcccggtccagaatgctatgattcccccagatatcatcattctcaatgaacacgctgccggaaagaaccacgcccattgaagtaacctcatccccggcatggtaaatgatttcatcttttttataagtcttttctaccggattcagacagttcagcatctgtctggcgtcctccttcgtgacgccccggaaaattgctgcctcctcaaatatgcccattttctgctactcctcaattctcaatgcatttctgtccgctttttaaccaaatcaaacagcaaaacaaattacgaatatccacctgactttatttcccaaagttatttttttcgtttctttctctgatatattctgcgtagtccatcttctgtctccttttgcaatcttgtttttatagccttttcgtcttagtatgtgcccggattgctccattactataccattcatgcttttggcacttacaccatcttactatatttttgcagaatcggcaaatctgttctgtttatctctgccggataaaacagcattctctataaacatttattcaataagatttttaaactcaatcgtttccagtctatacaaaaaccggagaacaagatttttcaaagttgtacatgacttgaacaatcccgttctccggttaatatcttatgatttcctgttccctgacataacctcacatttgtcagattctgcgtctattctataaacatcgcatccccaaagctgaagaatcgatatctctctttaactgcttcttcatatgccgcaagcacatgctctcttccggcaagcgcacttaccagcatgatcagcgttgactccggtaaatggaagttcgtgatcaggcagtccagtaccttgaatttatagcccggatatatgaaaatctctgtccatccactgcactcttttaactttccgttttcatcagccgcagattctacggtccggcagcttgtcgttccgacgcagatcactcggtgtccgctctcttttgcacggttgatcttttctgcctcagatgcctcgatccggtagaattccgaatgcatatggtgatccagaatatcatccgcttttaccggacggaaagttccaagtccgacatgaagcgttacatgcgcaatctccacaccttctgctttgatttcttccagaagctccggtgtaaaatgcagtcctgccgtcggagcagccgcagatccggaatgctttgcatacacagtctggtaacgattcttgtcctccagctggtgggtgatgtaaggcggaagcggcatctgtccaagctgatccagaatctcttcaaaaattccttcgtattcaaaatggatcagacggtttccttcctctacaacctccagaacttcccctttcagaagaccgtccccgaagctgactcttgctccgggtttcatcttctttcctggttttacaagtgtttcccagacatcatttccttttcgttttaaaagaagaacttcgacttttccgccggttccttctttttcaccgatcagtcttgccgggataaccttggtatcattgatcacaaggcagtctcccggtttgagataatctttgatctcacggaaaatgtgatgactggttgcaccggtttttttatcaagaacaagcagtctggaactggatctgtcttcaagcggatcctgcgcgatcagctcttccggtaaatcaaaataaaaatcctgtcgtttcattcttttgacctcttttcgcctacttacgaagctcgatacccatttcctccagtgcctttaagatacggttcatagcagctgaaatgtcagcttcttccagagtcttatcttttgcacggaatgtgatagagtaagcaacagacttgaagcctgccttgatctgagcgccttcatagatatcgaacagcttatagctttccagataagcgccacccttgttctcgatcacttcttcaacctgtcctaccaggatggattttggcattaccatactgatatcacggctgactgccgggtattttgcaattccttcgtattttctttcaaatgttgcaagctctgtgatctgtggcatatcaatgacagcaacgtatgctctttcaccgattccatagatatcagcaacttccggatgaacctcacccatgtatccgacaacctttccatcgtaaacgatgtttgcctgacgtcccggatgaaggaagttctttcctgcatttggatcataagtttctttcttatgaagtccgactttttcaaagaactcttctacaacacctttcatactgaagaagtctccatctccgtacattccaagtgtaaactgcattctttcgtccggcagttctgtcagtggaagtgcctttggaaggtaaatatttccaagctcgtacagacggacatttttatttcttctgttgtagtttgttgcaagagatgtcagcataccattcagggatgttgtacgcatgacactgtaatcttctccaagcgggttcatgatctggattgcctgacgcatcggatcatccttgtcgaggaggagcttgtcaaataccttcgggctttcaaatgaataagtcattccctggctgaatccacagaattctgcaatatttcttgctacttcttccacacgaagcttgaaagaaagcttaccagttgtagcttcacctgtaggcagtgtagtcgggatattatcatatccgtagaatcttgctacttcttccgcaagatcggcgatacggaataagtcatgacggaaggttggtgcgatcacttcttttgcttctgcatcatattccaggtcgatcttttcaaaatatttgatcatatcttcttccgggatgtctgttccgagaagtgcattgatcttgtcggcatcaaatggtacacgtacaggttcttttttcttgctgtatacatcaaccattcctccgacaacttcaccggctcccatttcttcgatcagctggcaggcacggttgattgcatcctctgcattattcggatccagtcccttttcaaatttaccggatgcatcggtacgaagtccgactttcttactggattttcggatgttggttccatcgaagcatgcagcttcaaataacatggtctgtacattgtcagtgatcatagaattttcgccacccatgattccggcaatacctaccgctttttcgccatcacagatcatcagaacagaatcatccatttctctttcctgaccatccagtgttacgaatttttctcctttatgggcattgcggacgatgatctgatgacctgcgatggtatccagatcataagcatgcattggctgtccgtattcttccattacatagtttgtgatatcaacaaggttgttgatcggacggattcctacggaagaaagtcttctctgcatccatttcggtgaaggtccgatcttgatattttttacgactcttgcacagtaacgtgggcaaaggtctgtattttctacttttactttgatgtaatcattgacatcttcatcatttccggttgatgttacaaccggtggcttgaattctttgtggaatgtagctgcaacttctcttgcgataccaaccacgctgaagcagtctacacggttggaggtgatctcgtattcaaatacgacatcatccagtccgagtgcctttactgcactttctccgacaactgcgtcatcatcaaaaatgtagattccatattccggtgcttccgggtacatatttctgtctgaaccaagttcttcgatggaacacatcattccgtagctgtcgactccacgaagttttccttttttgatcttgattccgccttctactctctgtccaggctcatgtccgcccgcaacgcgtccgccatccagaacaaccggtaccttgtctccttcttttacgttcggagcacctgtaacaatctgtacggtctctgttcctacatttacctgacagatgatcagtttatctgcgtccggatgtttctcaattttctcaatctgtcctactacgatcttatccagatcagcatccagctttgtaaaaccttctacctttgttccggaaagagtcattgcatctgtatattcctgcgctgttacgtcaagttccggaacatacgctttaatccatgataatgaagtatccattttatatctccttctgatttgtttataaatttcccttattcagactccaaaatccagcagctctccgcgctgctctttgattttgtcataccgttcgcacatgaaagtaaatgctcgcttcgctcgtgcttcctttttattcagactccaaaatccagcatctttcgatgctgccgcagctctccgtgctgctctttgattttgtcgtaccgttcgcacatgaaagtaaatactcgcttcgctcgtgcttcctttcattgtgtgctcactagaattgctttaagaatctgatatcgttctcgtagagaaggcgcatgtcgtcgatctcgtatttgagaagggcgatcctttcaagtcctactccgaatgcaaatccagtgtattcttccggatcgattccgcacatttcgagtacgtgtgggtgaaccataccacagccgaggatttcaatccatcctgatcctttacagaaacggcagccttttccgccacacttgaagcatgatacgtctacttctgcacttggctctgtgaatgggaaatgatgcggacggaattttgtcttggtatccggtccgaaaagttcttttgcaaatacttccagagttccctttaagtcagcaaaggaaatatttttatcgattaccagtccttcgatctgatggaaggatggtgaatgggttgcatccacttcgtcagaacggaacactcgtcccggtgcgatcatacggatcgggagcttgccctgttccatcacacgtgcctgaaccggtgatgtctgggtacgaagcacgatgtctttgttgatatagaatgtatcctgttcatcttttgccggatgatctgcaggaatattcagtttttcaaagttgtaaaggtcatattctacttccggtccttccacaacttcgtatcccataccgatgaagatacgctctacttcttccagagcgatcgtattcggatgacgatgacctactgtatttttcttggaaggaagtgttacgtcaataacttcctgttttaatttttcttcacggattgcagcatccattttcttctttgtctcatcaagaagttcttcaatagcagctcttgtctcattcacaagctgtcctaccttcggacgttcttccggagctacatctttcattccttttaatacggctgtcagttctccttttttaccaaggaatttgacacgtacatcatttaatttctccggtacatcagaagcctggatctgcttaatagcttcctgtttgatgctctcaagtctttctttcatgatatcctccttaaaacttgttttggctattcatttgcgactataacaggaaataaaatttcctgtggaagaaaaaagaatgtgccttggcacattctggcacctgcggcggtcgcttgtgacatcttccttatacgccgcagtacacatcctcgcggagcgtttttatacattaagaaagaacactttcctaatatataaaaaaaatcgcccctaaaaagggacgagataaatcgcggtaccaccctgtttcctgctatttgaataacaggcactcggactgcgtaacgtgcagggacgtcgttttctactttattttcaaaaacgcagctcacgtgggaaattcgtttcctgcctgaaccggggagaacttacagccggggattctccttctctgtcggaaaacagttcactacttacacggtcattgcttttatgatatgtcatatacttatttattgtaacatatgatttttttatgtcaagcggttttatctgatagattcaccgtttatctacgcaaaatcatattccggaacctggatgctgctttttgcagaactaatccttttccaggatatcccgctttgcatctacccagatacagttaataagccctcccagcagcatcacatacatacagaaatacagccacagcatcacaagaatgatcgccgtcatacttccgtacagaccggaaaaccctttgaagattgtcagatacattgaaaaaacaaacgagatcaccagccatcccagagaacagaaaatagatcccagaatcaaatcccggaacggaagcttccggttcggcaaaaagtgatataccagaagcgaaattccagtcataacaacaaatgaaatcaccgttctcaaacgcatgatcatatccgtcgtctccgcaagaaacggaattttgtgatatataaaaatactgatattattaccaaacacagaaagtaccagagccatcacaattgctgcaatgaacaggatcgtatagatggatgcccggattcttaaaaatacataatttcgtgtctcacgaagctcatatgcacagttcagtcctgtactaaccgcaagtactcctttacctgctgaccacaatgctacaatcgcagtaatcggaatgaccgtcttcgactggttatatacttcatttacaatgccaaccataaaatcctgcatatttgtctccggaaacaaatttaccactgcagtcataacatctgcttttgtcaccggagtatattgtatgatagcaagaagcagcaaaataatcgggatcatactcagcacaaaaaaataagcagactgggccgcgtatgctcccacatgcttttgtgacacctgccctgtaatttcccgaatcttgtttatcgttttcatcatataataactccatttatcttatcggcagtttcatttttcaaaatagtttatcacattttcacttctttgaaaacccaaaaaaacagttgctctcgcaactgtcctttatcttttgtagtcccccgaaatgccgttttccgttttttgactcctagcactccgctaggtgggcgaccgcatctgcttttctgccttcccctgcgcaatgagggcctgacatattacagagatataagaatcccgtttaaagtattgtaggttcaaaaatacggaagtctcgaacattccaggttttctaaaacctattatagactatcagctgtgttttttcaactgttaatcgttgaagatatttactttttttaccagaaattaaaatacgtttaacgtacccatttcccgctttttccaccggacttttcaagcagatggatttctctgatctccattccccggtcaaccgccttgcacatatcatagattgtaagaagagcagtatttaccccggtcagtgcttccatttccacaccggtcctgccggtacatgccgtgtggcagattgcccggatcccatgctcttcttccagatattcaaaatcaatctcgactttggtaaggtttaacagatggcacagcggaatcagttctgctgtcttttttgcacccatgatcccggcaattcttgctacgccaagaacatctccttttttcatgctgccttcctttactttctgaaagcattcttccgacatgcggatcacccctgatgcaagtgcttctctttttgtctcagcctttgaccccacatctaccatcactgcattaccatcttcgttaaaatgtgtaaatccactcatgatttttaacctctttattttctggcacattcgccttctgttccccggagaattccaagcccatgtccaagttcaggaagcagaaactccagtgcttcctgtactgctttgggacttcccgggagattgatgatcagcgttttttttcggatacctgatacagctctgctgaacatagcacgctttgtaatcgtcatcgaataattccggattgcctctgctattccgtttgccatccggtcacagacatttaccgtcgcctccggtgtccggtcccgctcggagaatcctgttcctccggtggtaaagatcacattaagctgtctctgatcagccagtctgatcagctctttttccagttttttctgctcatccggtaataaaatcgtttctttaatatcatatccgacatctttcaacatttcgacaatcatgggtccgcttttgtcttctcgttctccggcagagcctttatcacttaaagtaataactgccgctgaaaatggacggtcacttttcacctgttccatgacaacttcatctcctaccttgatatgacctccggtgacgacttctgcaaaaacgccctcccttggcataatgcagtcacccattctcttataaatctgacaatgactgtggcattcttttccaatctgtgtcatctcaagtaccacatctccgatatgaaatcttgttccaaccggaagtgcgcgaaaatcaaatccctccacgatcagattttcaccaaatgcaccatacgcaacttctgccccttttgcacgaaattcctgaatcttttcatcggaaagcagactgatctgacgatgccattttccaccgtgcgcatctccttcaatcccccagtccattttgaccatggcttcacgaacctcatgtttttcggttcctctcttttcactgatgcagattcccttcagtcttcccatttttatgtttatcctccgatctgtgacatatttttctgttctgtaataaaattctgctcctcaaaatgatgcatcttcggttttccacggatcgcctgttcgagacatttccggatttcttcttccgatccgtgtcttgctgcctcaaaaacggagatagtatctgcatagcacagacacgcttttaactttccggttgatgtcatccggatccggttacatctgtcacagaattttccatgcaatgcactgatcagaccgattttcccctgaaaacccggcagttgataatacacagcaggtccgttcccaaaccgtccctctaacggataaaactctccttctatcccataagcttctttcagttttccaagcacccaggcaccggaaatgccattctctgctcttccctgtccaatcggcatcaattcaataaaacggacatccagcttgttctttttcgccaactctgccagacttttccattcctcatcattgactcctttttgcaggaccgtgttgatctttacccggatctcgcttttttctgccatgaaaatggattttctgactctttccagttcatctgccccggtaatctcctgatatttttccggaatcagtgtatccagactgatattcaccgcatccagccccgctgcaagaagatcttccagattctcacccagaagaaccccatttgtcgtcattgttacttcttctgtgcccggaatctgccggatcatccggatcagatctgcacatccttttctgaccagaggctcccctccggtaatcttaaacctggtaatcccgatccggacagcctccctgcagattcgttcaatctcctcataagtcaggatttctgacataggaatccactttgccccatccggcatgcagtacctgcatcgcagattacagcggtctgtgattgaaattctcatatattcaattgttcgcccataagaatctctcacagccttttccatcctttcttaattccagagtggttccagtaacacctcgatcgtaccgccgcagaccatgccttcttcctccgcatcatctccggtcatatccacatattctgtctttagtcctgtattattttcatgcatcatgactctcgcttttcttaaaacctctgcctccatacagccgcctccgatggttccaacacagttgccgtcttccaggatcagcatcttggatcccacatttcttggtgcagaaccctttcttgtaatgatcgttgcaagcatcttctttcccggatgagcgatatccaggattgcttccagcaagtcttccggataaccgcagactctcttgttctgattctttacttcgatgatttccgccatgatcgccacaccgatctcctccggtgtctcagcaccgatgttcagaccaatcggactttttatctcgccgattacttcctggctgcatcctttttcaatcagattctgctttaccatcgcacttcttcgccggcttccgatcattccgatataagcatgttccttcccagcgatcttctccagacaaacctgatcatatctgtgacctctggtcagtacaacaaaatacgtatccttgtctccttcgatctgatccaaggcatcttcaaacggctggcagattacttccgttgcccccgcatttctggcatgatcggcaaactgcggacgatcttcaagaaccgtgaccttccatccaagcataatcccgattttgatcaccggcaccgatacgtgaccaccgccacaaatgaccagatgctcctgccctccaattatatcacaaaacacctgctgctctctgatttcataaagtccgcactttttcaagtctcctgcttctgaaaaatgtgctgaaaagaaaccgttttctttactttcccagattatttttttctctgccaaaattgctttttctccggctgcggatccttttgccactgtcaaaagaacgtaatcccccggctttggtaaatcttttaatatctcaaatacattttccatcaaatctcatctaccctactacatatttattcagtctgtcaaatgcttcttttaatacggttccatcctgaaacggatcggaatcttccggcatttcatctctcgcatgacattttcttttatccccatcacattttctctgccatgcaatacttttattgtaacaaatttttccgccaaatgaaataagaaggtgcagctctttttgtctgcaccttcccttttcctttattttatgatctgattttaaaaatactttgcattcagctttttgactgtccatgcaaaccataccagtactgcaagtaccagcactaacatcacccagaataattttcctgtactctgcacataagtattatacagatcttctgcgccgtacaagatcagcactaccgcaagcacaagaagcttcggtcctgctgctgccctgtatgcttccttatccttacacttctttatattcgtatcttttggtacaagaattgatgtattgatgattcctttgaatttaagttgaaaccatgcatacaggctatacaatcccgccccaataccaatgatcccgaaaattccttccattccgttcattcttttgccttctcctgtctattttacgccaagaatattcttaacagtctgctccatctgatccacatcacattccgtattgtgacggatctcggcattcatgatctctttgatggcattcggaagctctgtaccggatactttctgaagctcctcgatcagtttgaaatcatcctgtcctttatacttcgaatcgatcgctgacataacgcttcctgcaaatttgtatggacttgctgtggatgcgattactgtctttctgtcatctttactgtcttctctgtaagctttatacaccgttgcagctaccgccgtatgggtatccattacataaccggtatcttcgtatatatcatggattgtctttgcgacctgctcttctgtcgcatatcctgccgcaaaatcagccaggtttgctttcatctcacctgtaatcgcgtaacttccctttgtcttcagctcagtcataagatccgtatcttttcttgcatcttctcctgagatcttgtagatcagacgctctaagttgctggagatcagaatatccatagacggagatgttgtaagaacaaattcacggttacggtcataagttcctgtctggaagaagtcatagagaactttgttctcattggatgcacagatcagctttgcaatcgggattcccatattctttgcgtagtatgcagccagaatatttccaaagttaccggtcggtacaactacattgatctcttcatcttccgcaatctcttcattctgaagaagcttcgcataagcatatacataatatacaacctgcggaaccagacgtccgatattgatggagttggcagatgagaactggtagcctgcttcatttaactctttttccagctctttgttctcgaacattgccttcacaccgctctgtgcgttgtcaaagttaccgtggatcgcaacaacagaagtattgtctcctttctgtgttaccatctgcagctcctgtacgcggctgactccgttcttcggatagaatacgatgatcttggttccttctacatctgcaaatcctgcaagtgcagcttttcctgtatccccggatgttgcagtcagaatgacgatctcattcttcacctgatttttctttgcagaagtagtcagaaggtgcggaagaatggaaagtgccatatctttgaatgcgatcgttgctccgtggaacaattccagataataagcatcctccaccttcgcaagcggtgcaatctcttcggtatcaaacttactgtcgtaagcctttgcgatacagctcttcagctcttcttctgtaaagtctgtcaggaattccttcataactgtatatgcgatttcctgataggtcatctctttgagctcaccaagcgacaccggaagcttcggaatcgaaaccggtacaaataatccgccgtcatctgccagcccttttaagattgcctgggaagctgttactgtcttttctgcatctcttgtactcttataaagtaaattcatggttctccacccttcttattctttctgattcacttcagcaatctgctaaagtattttcctatttagcgattatagcataagaacctttcaagtgcaatgccatccttatctgcgtttccacattcgtccccacatccggctcagaagaaaacacaggagcagtgccccggtcagaataacaccgatcagaaataccagaatctttacataagatccatctcctgttgcaaccgtctttgctttctcagtttcctttggcttttccggactttccggtttttcctcttctacctgcttttcctttttataggttacactctgcccttcgtcctccagatctgcgtgcactgcaaccagcttctcttccagatacacttcctcaaatacaacaacctgttctccgttaagcttcgttgcatcaaacgtaaattccatctgaagttctccggaatctgtatccgggatcagctttttctctactgttacttcttttccatcctggagaaccggctctttggtctccttattcattagtgtgcctttaactacatattcttttccaatctccagatttttccattttacctgatctatgaccgttacctgttctgtccgtttcccgttatgcgttcccgtttcccggtcagatgctcttgtcccgatctccggtacgggatgttcatcatttgtcagtgtccccagatcaattactcgcatttcctttgttacttccacctcaaacgcaggaatcagcatccggtcttcattatttttacaagacagttcttccaccagatacgttccataaggaagcgctcctcttgtattatccggagttccttccccgaaccagatcccatcttcacttgtttcccccttattcgtgttgaccgtatgcagattccagtacgcaccggtcgaagcctccccgtttttgtctgtccggatcacatggctctccccagttgcctgcgatgtgatccgaaatgggatatccgccagtcttttcaaggttttatctgccgctttcaccagctttaaatccccacggatgagcttttcctttatttccactggattccatattttcagggctttatagcttccattttgctccgttccagtcctgatacaatgtgtaacggtgtccaccagatacccttccggcgcatgcatctcccataccgtaatcgttccaagcggaagctcgttattttcaaaaaacggatctccgctgatcaggtgcgcctcatccatacggaccacaccatccgcatccgacttcagcttccaactcctgagcggcaccttcacaccgatctcattttgattgtcaaaaatgctatcaaaaaatgccacatgaaattcagctcccgcaagagaaagtcctgcctgcgcctgccctttccctgtttccgcatcctgcttccggatcaggatttccacctttgtcttttccggttcatcctgacactcataggtcacggtctgtccggcattcaccgtgatctgccgtatctttgtgtccagtacatagcctttcggtgctttagtctctttgatgtcataggaaccctccggcagattttctgccttcccatatcctttcttgtctgtccggattacgcagactgcctcggatgtcccacttttacagacggtatactctgccccttccagtgagtagagctgattatcagccgtaatctctgaccttgcagagctcttcatgatctccaggcttccattatgggttgtcttaaaaagatatatcgttgatctggattttgccacaagctgtgaaatctgattaccactcgacgggatagatgccgaatgccagaaccggttatcgttgctattatctccccagaaaaatccgatatggcagtctgcatcttcttcctcccaggaaaccggctcaaaatagatcacatctcctttttgcgcttttccgcccgcaagcagttcctcaatggtgttgtaatgataggattccacggcattgtctgtcatccaatgaaaccagttgctcgcattgaccttgccgccacgaagacttcctttgtcaattcctgacagatccgctccacatttttccagaacataagcgacaaacccggtacagttcattgccccatttccaccgtaggctccgttcggacgcatgcagttctctgctgtcagaggatatccgctgtaaggcgttcccagataataaccgtccttttcgtgtttttttaactcctcaagcacttttcccggctctgctcctaatttttcatcaagttttacaatcgtttctttctttgcgattctctctgctgagtttgcagatacgacaggcatactgctgcccgacaatgatactaccgccagaatcacacttagtattccggcaaaatgattcttcatatatttcataaaagtttctccttctgccttttcaggtcagaaaagagaatataaaagacgagtacccttactataaaggaagagtacccgcttgtcaatagtattttattgttgatctgcctccagaacgatcacacttctcggtcccacaagaattctttcctccgaaatccgtaccggattctgataaatttcctgctttttatctccagtatttgccgccacatgccaactatatccgccaggaagttgtggaagttctacccagacatcttcccagtatggattcatcagaagatacacacagtcttcttttgccattttgttatcatatccggcaaacatgactgccgccgtccggatctccggtctggaaaaatccagtttccacggcacttcaccgtgaaagctgatctccggaaatccaagactgctcgcccctgcatctcctgtgatcgacggatgccgtttccgaaatgccgtcatataagcacaaaaatcaaatacatcctgaaacttttcttttcttgtccagtccagccaggaaatctcgttatcctgacagtaggcattattattcccgaactgagtattgccaaactcatcacctgcaaggaacatcggtgtccctctgctgcaaagcaggaccgcaaaagcatttttcatcatccggtggcgcagttcaacaaccatcacctgatcagtgtccccctctgccccacagttccagctccggttatcgtcacttccatcaagatttccccatccattagcctcattatgcttctggttatacgaataaagatcatacagggtaaatccatcatggcaggtcaggaaattcacagaagcatgttttccgcggattctggtatcataaatgtccggagaaccggcaattctctgaagcgctgctcctgctgcccaaagtcccccttttaaatattcccgcacgtcatcccggtatcttccgttccattctgaccatctgcggaatgccggaaaacttccgacctgataaagtccgccggcatcccacgcctccgcgatcagctttgtgtctgcaagcagcgaatcataggcaagattctttacgagtggtggattttccatcggtgacccatcctcatttcttcccaggatcgatgcaagatcaaaccggaagccgtccacccggtactctgccacccagtatcgcagacaatcctggatcattttgatcaccaccggatgattacaattcacagtatttccacagccactgaaattataatattttccatcgggtgtcaacatataataaatctgattgtcaaatcctttaaacgaaataaacggtccgcattcatttccttctgccgtatgattaaacaccacatccaggattacttcaatctggttatcatgcaattcccggatcagttcttttaattctactccttcccggttgtattccgttgatgctgcatagctcgtattcggcgcaaaaaagctgactgtattatacccccagtaatcaatcagtttctttccatcaacctcacggctcccctgcagttcatcaaattcaaagatcggcattagctccaccgcattaatccccagtgttttcagataaggaattttttctttgattccggcaaaggttccaggatgacggacacttttgtccatcttcgtgaatcccctgacatgcatctcatagatgatcagtttttccatcgggatcttatctggcttttcactgccccagaagaaattattccggactactctggcacgatatccccctgtatttagtgcttttccccatacactctgcccagtaactgcctttgcatacggatccagtaaaatatgctttttatcaaacagcagaccttcctttggtttccacggtccgtccagcctgtacgcatattcaaattcttcaatatccagtccgaataccatcatggaaaatacatccccgatccggcagttttccgggaatgggatcaccgcataaggttccggttcctttctgtgaaacagaagaagttcacatgtcacagccccttttgaatgcactgtaaaattaactgccgactgaaatgcagtcgcaccctcatcacgatacagtccgggacagatttcaaatccatttacattttctgtcggaacccatcttggcatcatttcttccagcattttaccagctccttccatgtcatgttttcagtatagcacatttttccgtttacacatctttcctttctgtatataatataaaggattacatattttttgcagcagactcaaggaggttttttatgactgcacagcatctatattatttatttcagtgcttctttatatatgcctttttaggctggtgtacagaagttgcgtttgccgcttttaaagaacgtcgttttgtcaaccgtggattcttaaatggcccgatctgtccggtatacggtttcggcgtggttgcagtcattcattttctgacaccgcttcgttccaacctgctcctgctatatctcggaagtgctattcttgttactgcaatcgaatggctgaccgggttcattctcgaaaaggttttccataacaaatggtgggattattctaatatgccgctcaatctgaatggatatgtgtgccttttgttttctctgatctggggagtgttctgtgttttcatcgtagatgtattccatccactgattgacacactgctctcacacattcctttccttgtcggtatcattcttgtatgtattctggtgattgccggacttgccgatctctatgtaacagcatccggtatcctgaagctcaataaacgtcttgaaaaaatgcaggccattgcagacgaacttcatcagatttccgacaagcttggtgaatcaatctacaagcgtaccattacagctatggaaaaacaggaagagttcaaagatactgtatctgagaagcaggaagaatttaaatctgctatttccgaaaaacaggaagcaatttcagacacccttgccgatgtttctgacgaagtaaaagaacggattgctcttcttcgcagaagctacctggaaaatgtcaaagcaacttctcatatgcagaagcgtatcatgaaagctttcccgaaaatgcagagccgcaattacaaagaatcctttgaagatcttagaaacaaactgaaggaaatgtctctcaaaaaataacaggttgtaaaaaatccatctggttttcttttaaaaaaagaaatcagatggattttttatctttaaaattatgatgtgagtatcaaaagtaaattttaccactcactaatgtttcctcttgatcttatccagatacggaatctcgattggatcgattgcatcaagtggctgttctttattgatcttctttttgcgtgtgtgctttttcagaagtgcaccaccccggttataaaaccagaaagaaaagatcagaagtttattgaattttccaattttgtcttttgtcgtcttcgtgtaatactccccaccggactggatctctcctttttccctgatctgccggatcagatccagctctgtctcaatccgtaccggaaattccgtataccccatgccgacgcagtccagcttatgcgcatcacttcctccggttcccggttttccatatttttcagcaagatacttcgccccttcattggactgtggtggctcacatgcattgaaagtctctataaaatcaaatttttcaatcaactccggagatttctgccatcttttcgtattcgtaaaactcagatacttttccccacacggatgtgccggtccacagattcctccattgtgatgcacaaaatcaatcagcagcgaaagcggaagccctctcagctccagaaggcgcatctttactccctgtggcataatgatcagaatgtgtcccgcatccagtgtatcatactctattcctttcaatacgacaaaatctttgtattttctccctttgaccgtattcttccagtgccgatatccattataggtgtcatgatctgtaaccagcattccgccaatgcctttagactgcagctttttaataaattcttcaatcggcactttgctgtcaattgatccttctcttacatgacaatgcatatctatcttcatattttcatctccagatcttatatcgttgatactatttttattatacctctttttttataacgctgcaagaaataccggtttcttccagccattcctgatcaaatgcaaaagaggatgtatcacattctgatacatcctctcatccatcttatctattcttcatcctcgtcatcatcatcatccagatcgatcagcatggttcttgccatctctatttcttcttcttttgatgtttctttcttgatcgcatttgctcttcgaacctgcttcttgttaatctcacttgacttcataataaactggatcacgattccgataaatgtaatcccaatcgaaatgatccacatgaaaatcacatttttcagacctgccagatcatagatcatcattcctgctccaaaaccgcctgctaatgccgtcgcaataatcacaaacggttcaaaccagatcatcgcaaggattgcgaaaatcagtccgactgctccgcagactgccagcatgatccagtttcccgcatttgtaatcgcaagtactgtgccagccattcccagaaagcatacccagaaagctccgaatttcttaaatacactgttcagtattgcaaaaaccaaacccgcaacaccggctgcgatcagtaccggaacaacttccagtcccataagatatgtcacggcaaatccaagcaatgcccctgcaacaaatccaatcactgcattccagacacggatcagcttcaaacctaaaattccaatgaaaactgatataacaattgataccgccgaaacaatcacggcttcttttcctgctataaataccgcactatttcccatgatatccttcaatactatacctattgattccatcctaatctctcctcctgtcgtactttcctgttgttaagtcagacgcttattttgatgaagagtctgaagatgtatctgtatcttcggtcgtgctcttaaccgttacgccctgatcagcaaaactgatcgtattccatacttttttatgtactttaatatccgttttctttttccatttcttacaaattgactgatactggtcactctttctctgtgatacaatggactctttcttggtatccgttgcatcacggtcaagaaggctgactacttttgcaacataatagccattgtctgcttcgatcacgtctgttacttcaccttcttttaacttatcagcagctttgatcagatcttcgtttggcgatgtcgtatccgagtcaaatgtcagatcggtggctgatgcacctactgctgttgcaaatacagaaaaatcttctgccgaagccgcatctttctggaaatcttctgctttctttttcacttctgctttttcgtcatctgacatatctgtcgactttccatcactgcccgttgtctttgtagagaacagcacatactgcattttcttctgtgctgcttcctcatcggatacattcgtatctacatccgcagtcatggcagtttccatcttcttctgaagtgtcagaagttccagtactttctttaccgtcttttcatcgcccgatactgtatcttttgcagcactatcattgctgtcagtaaatttcttcgcagcatcctcgatacttttttcctcatcatcacttagcgaaactttataatcatccttgtgctcatccagaacatacatttcttccagagaatccatgattgaatccttataattctcttcataagtctttccgtctgtaacttcttttccccaaaaattatctcccagataactgctatatgttgtttcaaactgcgcctgctgatatcttgcaaaaaagttcgccacatctgcagtcactttctcatctccgacttctaccactgtatcctgtccgttaaacttgcttccacatccgtttaaagatgcaatgcaggcaactgccagtatacaggcaaccactctttttttcatttataaaatttcctccttgatcttctctccattgtacacacttcttcactatgcactcgtatagtatatcttttttttaccttactggcaatctttttcataaaaaatacacattattcttcgacaagtccctgtatatcttcgacaatttttcctgcattttcaagaatctgctctgctttttcttttttatttttccgaagtttacaataaataaaatatggattttctgcatctgtcttaaatgtcagttctcccttatattttgccagcagttccggaatctttgctacatttacccttgccttctcatacatggtaaatttgtattcatcgcctttttgctctaccgaaattacataagccgcatgtgctttcgccttcagctgcgcgatcatcagaagctgctgcacttttcgtggcggatcgccgaaacggtcaatcagttcttctagcatatcttcctgttcttcttctgtctcaattgctgcgatccgtttatagatatccagtttctgatactcattcggaatataagatgccggaatataagcatcaatattcagatccacggttgtcgcataggtttcttccgggatttctcccttcaggtgacggactgcctcacttaacatcttacagtaaagatcgtatcccactgcatccatatgtccatgctgttcctcaccaagcaggtttcctgccccacggatttccagatcccgcatggcgatttttacaccagagccaagatctgtaaactcacgaattgccgaaagacgtttttctgcaacctcccggagcattttgtctcttctgtacaaaagaaatgcatatgccatacggttcgatcttccaactcttccacgtagctgataaagctgggagagccccatccgatctgcatcatggatgatcatggtattggcattggaaatgtcaagaccggtctcgatgatcgtcgtcgataccagaacatcaatttctccattgatgaaatcgtacataatatcttctaacttgtgttcccgcatctgcccgtgtgcatatgccacatttgcatccggcacaagtttctggatcttcgctgccatttcagctatatcctggacacggttatagacatagtacacctgtccctggcgggaaatttctctttcgattgcctcccggaccatctcatcattctcctccatcacataggtctggatcggcatccggtcaactggtgcttcttccagcacactcatgtcacggattccgatcagactcatatgaagcgttcggggaatcggtgttgccgtaagtgtcagaacatcaatattttccttcagctttttgatcttttctttatgctgtactccaaaacgctgttcctcatcaatgatcagaagtcccagatctttaaatgccacatccttactcaatacccggtgggttccgatgatgatatcaacctgtccctttttcaaatcttcgatcgtttttttctgttgtgcaggtgtgcggaaacggcataacagatccacccttaccggaaattctttcatccgttgcacaaaagtgttgtaatgctgctgtgcaagaatcgtagtagggaccagatagacaacctgcttgttctcctgcactgccttgaatgctgcccggattgcaatctctgtctttccaaatcccacatccccacagatcagacggtccatgatctttgggctttccatatcccgttttgttgcctcgattgcaagctgttgatcctccgtttcctcaaacggaaacatttcttcaaattctttctgccagaccgtgtccttttcatagacaaatccttctttggactgccgtactgcatagagttccaccagatctttggcaatctgccagactgctgtctttaccttgctcttcgtgcgatgccattcctgtcctccaagtttgttaagtttcggctttttagcatctgcactggcatacttctggatctggtcaagctgtgtcgcaagaatataaagatttccaccatcagcatacgaaatcttcatataatcctttgtcaccttatcaacttctatcttttcaattccccggtagattccaagtccatgattctcatgcactacatagtctcccggtttcagatccgaaaagctgcttattttctgtccatcataactttttcgtttctttttcttctttgtctttccaaaaatatctgactcagatatgacaataaatttaatcatcgggtactcgtatccgacttctatatgcccgtagcataccatgatctcccctggattcacttctcgttcctgatcctcactgtaaaaactgctcagatcataatcacgtagatcctctgccagacgttttgcccttgttctggacccagaaatcagaaccgcccggtatccgttccttttcagtcttttgagatcctgtgtcagcatctcaaagctgctgttatacgggttaacgctttttgcctggatcccaaaccgctttttcacaaaaaatggcttacatttcatttccagagcacacatcccgatcatacagaatttgttcagaaattttataatttcatcagtcgtaaaaaattccggagcttcttccatttccccggtcctttccatttcttctgcacggttctctctcgctttttccacttcattttctgccagacgccctttttccagaagccttgctggttcatccaggaacaccagtgtgtccttcggatcaaagtagttgataaaagaaactttccggtcacttcccagtctgtcatctgccggataaataacgatctgttccagattctctacagatctctggctgtccacgtcaaaagtccgtattgaatccacttcatctccccagaattcaatacggatcggcaattcctcggtaagtgggtaaatatcaatgattccaccacgaactgcaaactgccccggaccatccacctgggcttccctgtcatatccaagttttatgatcttctccttcagcgattcaaattccagcgcctccccattggaaatggtcagaatgtccccttttatttctgcttccgatggcagttcatccatgaatccgtcaatcgttgtaatgaccgtaacctggctttttgcctccatcatcatctgcaaggtttccatccgctgtttgaccagctgttttccgtggatatctgcctgataaaaaaggagatcctttgccggataatagctggtattttcatttaaaaaacgatattcttcgtataatttttttgctttatcttcactggaaagaacgatcaatgtatgcccataaccttttccaagcgcatacatcaaatgcgttttctgtgatgtcacacacccggaaagaagcagcatgcccggttcccgtccacgctcttcacagatttcttcaatctctgccagttcagataaaggagccgtaagtgcatgcatcgctttttgcctcctcttattctttctttttctggttatattcgttcattgcctgatcgattgctccctgcatgatcagagcagaagcttcacaggcaagatcatatccttcttccataagtacacggtcctctttggaaaattttccaagaacataatcagcaagatcatatcctttcggtttttctcccacacctaccttgatccgtggaaatacactacttcctaaattggcaatgatatttttgattccgttatgtccaccggcacttccttttctgcggatcctgagttgtccgacttccagactgatatcatcataaattacaagaagttcttcttcgggatcgatcttgtaatattccaccagactacggatactctctccactcaggttcatataagtctgcggcttcacaagaagcactttctgtccctcgatcactccttttccgatgagggcacggtgttttttagtatcgattgctatctggtatttctccgccaggcggtccaccacatcaaatccaacattatgtcttgtcccctgatacttttcatccgggtttccaagtcctgcaattataaacattctattcacctctgctttttctctttcctgattctactaaatcctttctcttttgtcacgcatttctcatgcataaactattttttcttttcatatagtttattaagcggcataacctgccgaaattccatactgcctaaggaggttctttatgaattccaaaacaaaaatcatcgtacttcacatgaaagaaattatctatactgttatttttgccactttaggtattctcatcctctgccttttattctttatgttctccggaaaccggcattcctctgtatccgacaaaaaatatactcccggcgtttatacctcttcttttacactcggaaatgaagatctggaactggaagtttctgtctctgacacctctatcaattccatccgcatttccaatctaagtgagacggtaactgccatgtatcctcttcttcagccatctcttgagaatctggctgaccagatctgtaaatcccagtcccttgatcatcttacgctttcaagtgacagtccctatacttctcagcttcttctcaacaccatccgtgatgcgctcaaaaaagctgcggcaaccaactgatgccgcagctcttttccttttattaaccttccacgatcagatactgtccgttcggaagtgcgaatacttctgaagcctcttccagctcttcatcactcataccactgatgtctgctccgctttcatccagataatctctcacatccttgatagaatctacaacaaccgccatacagtcttccaaaaacgcttctgcctcttccagtgtctctgcaaccggctcatcaaaaagctgtgactgcatattcaggaatgtctgcagacattcttcatcatactcatacatacaggcaaccctcccttatctttctcacagaaaaattttctcatctgaactataaatagttaagcaattcttcagcatgtgcaattgttgcatctgctcctgtctccacaagaagttctttggtccggaatccccattctgctccgactgtaaacataccggcagccttccctgtcttcatatctacatccgagtctcctatgtatattccttcttccggcgatacccctaatttatcaagtatccacagaagtccttccggatccggtttcttcggaaattcacccgactgcccctgaatatggtcaaaatatccttttccaaatgtactttccactacatcgatcgcctgcaaatgtggtttgttggaaaatactgcaatctttattcccttcttcttcagtgaatctaacatctgaacaacgccatcataaggacgtacatggtacatacaattttctccaaagattctgctgtacacttccataccttcttcaatcctcttaagctctgtgtctccggacgcacgaagtgcacgttccataaggcatctggctccatctccaacgaagcttcggcactgttctttggtaatcggctcaagtcccatttcttctaacgtcttattcgttgaataagtcagcgaatccagcgtatttgtcaaagttccatccaagtcaaaaatacacgctttatacattgctgttctcctgttcttctgttctatgattataatagtatgaaccttgacaaatttcaactggaaatctctatttttctattcacttcgcagatattgtcgcatagccctgagtgcattcttttccaggcggcttacctgtgcctgtgagattccgatttcttctgctacctccatctgcgtttttccttcaaaaaaacgaagtctgataatatacttctccctttttccgagtcggtccattgccgcctgaagagacagtttctccacccatctgtcttctttgttccttttgtcactgatctggtccatcacatacatagcatctccattgtcattatataccggctcatttaagctgaccggcatctggatcgcatccagcgcatagacgatctcttcctttgcgatcccgatttcctctgcaatttcctgaacagtaggttctttctggtttactttgacataattttctttcgcgtaaatggctttatatgccgtatcacgaagtgacctgctaacacggatcgaattattgtcccggatgaaccgccggatttctccaatgatcatcggtaccgcataagttgaaaattttacttccagctccggattgaaattattgattgccttgatcagtccgatgcacccgatctgaaacagatcatccggattttcactgcttcccgaaaagcgtttgatcacactgagtaccagacgcagatttcctttgatatactgttcttttgcctcctcatcccccgctttgatcttctcaaaaagcacctctttttccccgtcgctaagcaggggaagctttgctgtatttacaccacagatttctactttattaagtaccatctcaataaacctccaaatctttactggtataaatttttctcaaaactgtttttatttattcgattcccactaaaatattaaaaatatcgctccttgacttttcccatactcttctgaaagaatatacatcttagtaatattgtctgattttctatcatttttctttaaattatagtataatatactaaaataatttttacgcaaaggggttgagtatatgaaacttacttttatcggtgccgcccatgaagtaactggaagctgccattatcttgaagcatgtggaaaacatattctaatagactgtggactggaacagggacctgatctgtatgagaatcaagaaatcccgatcaatccttccatgatcgactatatcctcttaacacatgcacacattgaccattccggcaagattcctctgcttgtaaaaaatggttttaaaggagaaatcatctgtacattcgccacctctgatctgtgcagcattatgctccgtgacagtgcacatatccaggaatccgaagcagaatggcgaaaccggaaggcacttcgttccggtgctccgctttacgaaccactttatactgtacaggacgccatgaatgcagtcgcacttcttgcgccgatcgattataaccagacgatccagctctgtgaaggaatcgaactccgcttcacagatgtcggtcatctgcttggttcttcctgcattgaagtctggatcacagaagacggtgtaagcaaaaaaatcgtattttccggagatgtcggaaatattgaccagccgatcatcaaagatccgcagcatgtggatgcagccgattatcttgtcatcgaatccacctacggaaaccgggtccattctactgtaaaaccggattatattaaggatcttaccagagtcctgcgcgaaacctttgccaaaggtggaaatgtagtcattccatctttcgcagtaggaagaacccaggagcttttatactttatccgtgagatcaaagaaaataatcttttgccggaatatcagaattttgaagtttatgtagacagtcctctggcgatcgaagcaaccaacgttttccagaaaaatgtacagtcctgctttgatgaggatgcaatggctctgataagtaaaggaatcaaccctcttcttttccagggactgaaaaccacgatcaccagtgaagaatctaaaatgatcaacttcaatgacaaaccaaaagtaatcatctctgcttccggaatgtgtgaagccggccgtatccgccatcatctgaaacacaatctctggagaaaagaatgtacgatcctcttcgtaggctatcaggcagttggcactcttggccgcaagcttgtcgaaagcaaaccggaatcagtccggctctttggcgaaaatgtagaggttaatgcccgtattgaagtccttgcagggatcagcggacatgccgatatgaatggtcttctgaactggattgatggattcaaagagaaaccatcccacatctttgttgtacatggagaggattcggttacagattctttcgctgctaccatcacagaccgtttcggcattccggcatttgcaccatactccggaggctgtgttgatctcgcaaccgataccatcctttctgaaggtatcaggcttccgaaaaaagcagttgaaaagccggccaaagcacgtgctcttactgcattcaaccgcgtggttgcggcagccaaacacctcatggatgttgtgcttaaaaatgaaggtcttgcaaacaaagatcttgcaaaattcgagtcacagatccagaatcttgctgacaaatgggatcgtgacgacagataaataccgatcttatctttccagagaccggcttccgacatggaacgccggtcttttcctgtctttttcgacaattctttaaaaaaatccagcatttcagcatgtcgaataaaattattctgtttttcccatcttctgacaaaatctgaaacacatcttttctataataaagcatgcttaagtaccaaatctatttagcagctaaagagaaagaaggataagactatgcagtatgaagtatatctggatgtattgtttctggaaaatatgatgatggattttctgattcttctggcagtaaaaaaagtatttccatgttctgccacttatggaagtcttctttccggttcctttaccggttcactactgacctgtgccattttattttttccatgcccggtatggacccgctatatcctgctgtttttcctggtaaattcctgtatgacagtgatcggattgaaaatccggacatttcccgtttttttcaaagcatggattctgctctatcttgcaagctttcttcttggaggtatcatgagttggctccgtctttattttggaaaatttttccggatcatatcttttcttttcacccttggcatctgtggtttttttcttttatatcatggacttttgtttctaaagaaactatggaaatcacaagatcatagttttgatgtgattttaactgtaaatggaaaagattttcatctgaaagcctttctggacagtggtaatcatctttctgatccactgaccggaaagccggttcatattatcagcaaagacgcctgtcagaagatttcttcccaaatctcacctggaagactccggtacatcccgtaccggactatacagaagacgaccagtattcttcccgttttttctgtcaagaagatgagaataacaggagaatctgaatttttgatccaatctccactgatcggtatttccgaacagaagaattttggaaacggaaaatatgaaatgctattgcatcctgaagattgttaggaggattataatgatgataaaagttgctgtttcagattgttttaaattgaaaatgattccctctttccgcagtgttttcttcccggaaaagcaggaaatccattacataggagggacagatatcctgccgctcccacttagcagtgaagaagaaggtcatgccatttcccttctcggaggcgggcaggatgaagaaggaaaaaagcttcttattgaacataacctgcggctggttgtatatatagcgaaaaaatttgacaataccggtgtaggcgtagaagacctgatctccatcggcacaattggactgatcaaagcaatcaataccttcaatccagagaaaaatatcaaacttgccacctatgcctcccgttgtattgaaaatgagatcctcatgtatctgcgccggaataacaaaaccaaattggaggtctccatcgatgaaccgctcaatgttgactgggatggaaatgagcttcttctctccgatattcttggaactgaagaagataccatttatcgtgatatggaaaccgaagcagaacacaaacttcttgggaaagcaatcggacggctttcaaacagggaacgggtaatcgtgcagatgcgattcggactcggaacccccgacggggaagaaaaaacgcagaaagaagtggccgatcttcttgggatctcccagtcttacatatcaagacttgaaaagaaaattatgcagagactgcgacgcgaaatggtacgctatgaacagtaaactatgaaaaacagggaaacagtaatttcttactgcttccctgttatttcattcttatttcttaaagaaatccggaatcttgatagactgctctttcaccttgctctgtggagttcttgcactctgaagcggtggtacctgtgtagtctgctgctgtaccggtctgcctccatataccggtctttctacattgctgtattctcccggattaaactgtggacgtgaaatattgcttgctcccattccagatccaccgttcatcatagctgctttatgttccagtcttgactgaagcttgctctgtgttccacctacattgtgaagacctgttgcgataactgtgatagttgcttcatctgacttggaatcatcatacattgcaccgaagatgatgtttgcatcttcacctgcaagatcctgtacatattctgctgcatcactcgcatccataagtgtgatgtcacctgaaatgttgatgataacgtgagatgcacctgcgatggttgtctcaagcagagggctggcaactgcctgcttaactgcttcaagagccttgtcatcacctttgccctgtccgataccgatatgagcaattcctttatctgtcataactgtctgtacatcggcaaagtcaaggttgatcagtgaaggtacattgatcaggtctgtgataccctggataccctgctgaagaacttcatcagctttcttaagtgcttccggcatagttgttcttctgtctacaatttcaagaagcttatcattcgggataacgataagtgtatctacattttcttttaatttttcgattccggcaagagcgttgttcattcttgtcttggattcgaatttgaaaggcttggttacaacgccaacagtaagtgctccctgctctttggcaatacgcgcaacaacaggagttgctcctgttcctgttccgccacccataccacaggtaacaaataccatatcagctcccttgagtgccgactggatctcttcagcactttcctcagctgctttttcaccgatctccggtttagcccctgcaccaagaccctttgtaagcttgtctccgatctgcataagagtcggagctttacataactgaagagcctgtttatctgtattgattgcgataaattcaacacctgcaatctgttcatcgatcatgcggttgactgcattgtttccgccgccacctacaccgactacaattattttagctgctgcttctgattcatttgttttaatttctaacaagagtttctcctccttcgtcaccttattatattatacaccctaaatgtcaatatgcgcttagttatacataagactataatatatttttttccgaaaaatatcaatagaattttgtatattttcctatttttttattcacttgacacagattatgttccaaggtccggaatcacatctttttcgaaggtaattgtaatattatctgtgttaaaattttccagatacagggttcctccctgatctcccagcttctcaaggatcggcgatatctgcatgatccgttcttccagattcgtgtgcccgacattgacacatttgtttccaaaaaaaagatacagatctgaaccggaacaaacaatcttatccggcgcgagatcacattttttcagtgtcatcgtcatatccagaaggttcccaaatgcttttttgttcgccttgctgaccggaagttctttgtaaagctgtactttctttacttccagcccttcaatgcacgggattccatcccacagctcctttgtctttgcaagtacgataccatccttgtcaaaataaatacattcatcacctgacacgatataaccggccacacgcttctctttgatcgtcaccttcacagtccacggattcttcatcgtcacatttgcctcttccattgccggaagcagctcgtgattcatcaggtgattcctgatcatcacatacagagaattggaagaccaattatcatcctgcacccagtctgcaatctcctgtctgctaagatactgatttcctgatacttcgattttccgcacttgaaagagtaaaagaaacgtaatcatagctatgcaaaccaaaataatgaccagaatggctttcatggcagcttgctttatgattctctttttcctttctttctgtatcatcccatcaggcatcttcctccttccgtcttttgtatatctcctgtttagtctaccacttgtgacacacttagcacaagtcccatttcaattaaaagaaacatcaccgatgttcctccataactgatgaaaggaagtgtaatccccgtattcggaattgtgttcgtcacaactgcaatatttaaaataacctgaatcatcatatgtgccatcgctccggtcgcgatcagcgcaccaaaaagatccctgcttccggatgcgatcaggaaaaagcgccagatcagaagcagaaacagaaaaacgataatcccagcacctgcgagtccaagctcttcacaaataattgaaaagatcatatcattctgtgcctcaggtacaaatcccagcttctgtacactgtttccgatcccgactccgaatactcctccagatccaatcgcgtaaagcccctgcagggtctgataacccttttcatatttttccggatttctccagatagcaagccgttccagccgatagctttcaagggcaagaaaaattcccataaagcaggcgcctgcgattcccatcaaggcaaattgcgcatacttcgggcttgcaacaaagatcaggatcacaccgattcccagaataatgatcgccgtgcttaaattactcgctcccacaagtcccacgattggaaggatccagaacatgatcctgcaaagtgtccacatttttccgattgtttttacgttcttcgtcacaagatccgccagaaaaagaatcagtgcaactttcgcaaattctgatggctgaaaagaaaacgggcccaaagctaaccatcttttggacccgttaatttctctgccaaacaacatgaccgcaaccgaaagtgcaactgctgccagataaccaaatactgccagtctctgccagatgtggtaatccatccctgccacgaacagcatcagtacaattccaagcaccgtcgcaaacgcctgctttttcagatagtaaaaggaatcatgaaatttcacctgcccgttatatgcactggtactgtataagatcaccagtccgatcacaaccaggagaacaacaatcaacagaagcgtgtaatccatacgcccctttttccctttttcctccactttgtttcacgccctttgatacagattatatgaaattattttatttcttttataatgcattcacgtattttttgaattcttccccacgcacttcatagttcgggaacattccccagcttgcacatgccggtgacagcagaactgcatctccgggtcttgcaagctccacacaggtatcgagtgcttcttcgaaagtatcttttaaaatacagtcatgaaatccgcactctgctgcttctttctgaatctgctcttttgtagcaccgatcagtaccagatagcggacttttccatcaaagctctggatccattcatggaaatcggactgtttatcatatccaccaccgatcaggatcgtcgggcggttcattgcctggattcccttgatcgccgcatccggattcgttcctttagagtcattgtaatagacaaccccgttcttctctgccacatattcaatacgatgctcaacccccttaaatgcaagtacagacttacggatcacatccagatctacaccgtaagctgctgccattgcaaccgctgccataacattctcataattgtggacgccaaggatctgtaattcgccggtcttgcagatgaccgttccttctttctccttttccggtttgtatacaatgtcttctccgtcaagataaatgccctgttccagtttatgcttactgctgaaaaatagaacacttgcctgaaattcatctgccatctttcttgtctcttcatcttcataattgagaacacagatatcttctggtgtctgattcttcgcaatattcatctttgcacgaatatatgcttccatcgtatgatggcggttcagatgatccggtgtgatattaagaactgcacttacctttggatggaaggtatgaatactctccagctgaaagcttgagagctctgccacgatcacagaatcttctctggtatctgctgcggcattcgtatatggtgtaccgatatttcccacaacaaaaacgctgtcacgggcatttttcataatctcgcctaaaagagaggttgttgtcgttttcccattggttccggtaattccaagcacatctccttttccgcatacataggcaagctcaatctcgccccagacaggaattcctttttctttcatagccagaacaaccgacagatcagtcggcacccccggactcattacaaccagatcaagactttccatctcctcttccggaaaagctccgagaacaacgcggactttgcttccctcacccagctgtgctttcattgcctcggcatcttttttatcatttccatcatacagaattacctctgccccttctttttccagtaatccgcaggatccgatcccactgatccccgcaccgaataccaacactttctttccttgtaaatccattcttgtaagcctcctataatgccagcagtgcaaccaggcacagaattgcagttacaattgaaaatactgcaaccacccgtgtctcgctccatccacacagctcaaaatgatggtggatcggcgccattttaaagaaacgctttccgcctgttttcttaaaatatgttacctggatcataactgataaaacttctaccagatagatcgatcctacgatgataatgaataatggcatctggagcatgtatgctgtcgaagcaacaaatcccccaagagccagtgatccggtgtcgcccataaatacgcttgccggataaacgttgaataataagaatcccagcagcgcacctaccactgcacaggtaatcggttcgatcccactctttgttccgatcgcaacaactgtaaagaaggttgccacaagaactgttacgctggatgcaagcccgtccagtccatctgtaaaattcacaccattgacggtaccgatcactgcaataaaaagtaccggaatggcaaaccagccgatgttcagatatttcccacctgaaaacggtatcagcatggtaagcggtatcttcgccactttcacgatgtaaaacgcaaaaatcgctgtaatcacgatctggagtgccatcttctgcatcggcatcagtccatctgatctgtgaagaacaactttcagataatcatccaggaacccgaccagtccgaatccaatcgttacaaaaagtaccggaatcaccttcggatactctcttacatagatcagcgaagtgaccgcaatcgcaaacaagatcatcacgcctcccatcgtcggcgttccagcttttttaagatgcgacttcaccccgtcttctctctctgtctgatccatcttgagtcttcttaaaacaggaattaccaccggtcctgctgccacactgagaacaaacgcgatcagcaccggtatgaccattgtaaaatccataatacacctctgtctttcttttgttttcaaaatcagcccttaccttaaaggcacagattctacgctttagtataatgtatctgccctgttttttcaactgcttcacgggttttcttcccgttcgattccaagatagggaagaatattgtcgaaaatatcgcgcacaaccggagctgctatcgtcccgccataatagataccctgtgggttgtaaataattgccattgctgctatctgcggatcatctgcaggtgcaaatccgataaaagatcctatataacggttcgcacttcttggcagcgtctggctggtcgctgtctttcctccgatccggtatccttcgatctgtgctttttttcctcctccctcggacacaaccgtttccagtatctttctcatcttttctgacgtttctttagaaagaatccgttttctttttccataagaaatcgtttcttctttctctccactttccgcatcataaacggcgacgccaaaatgaggagtgatcctttttcccccattcaccagagaacatactgttgttgccatctgcatcggtgtcacctgaaaagactgtccaaacgacatcgttgccagctctacctgccctacattttccttcttgtgcatgatcgttgcagcctctcccggaagatctacacctgtcttccccatcaatccgaatttttcaaaatatttataaaaattctctgttccaagccgcatccctacttcaataaaaaccggattacaggaattctgcaccccctgtacaaacgtctcggatccatgtccagtcgtcctcgcacaccggatccggcggtcttccacaagcttgtatccaggacagtaaaaagtatcttcttctttgaccactccctcttccaacgccgccgaagcagtaaataccttaaagatcgatcctggttcataagtatcattgatactcctgttccgccacatctgattcagcattgcctgtttttcttcatcattcaaagcggcatctgttccctccggtaatgtaaacggggcattcagatcaaactctggagcattgacgcaggcatagatttcccctgtttttggattcagaatcaaaatcacaactgcatctgcctgcttttcttccattactttttccgcagcctgctgtgcatattcctggatattatagtccaggcttacctgcagagtgtctccggaaaccggttctactctgtcttccatcgtatccgcaagctcaatccctctagcatcagttgttgtcagaatcattccgttcacacctttcagataattttcatactttacttccagtccaatgattccctgattgtctccaccggtaaatccaagaacctttgaagccagattgtcatacggatagtaccgtttaaaatcctcatctaccttcaccccgtccagttcatatgcacgaatccggtccccggtctctttctccacatttgtctttattttttctctggaagaaactttttcgattcttttccgaatcatttctttctctattcccagctcatcggcaagaacctggatcactctctccggatctgttatctgactatggataacagatatggtacacaccgctttattggtcgcaaggactttgccatttctgtcaatgatctctccccttgccgccttgatctccctctctctttcgtgcagcgtttttgctttctgttgataatacgcagcatcaaatatcatcaaatacaccagtcttgcgatcagaaaaaaaatcatcagaagcgcgcttaaaaatactaccagcattttctttttattataagtcttattccgcataaaaaccccgaaaaacagattcttactattactgtatgatctgtcttccggggttatacccaaattactcagccggagcctttgtaatattcaaatacggaaatgcttctgccataatatcagaagcgagctgcgagatcaggctgctggtcgctgactgatccggagcattcggttcatcgatgactacataaatcataatttccggattctcctgcggtgcatatccgataaaggataccacattcttattctctccacggggcaatttttccgctgtaccggtcttaccaccgatatcataaccttctacctgtacatatctaccactaccgttctgaacaacactgtacatataacttttcagtttatcagaagtttctttagaaattgtcttcttctccaacaccggatcaatagtctggatcacatttccgttctcatcctgaatagcttttacaagatgcggttcataataatcgccaccattgatcagagaacagaatcctgtcgcaagttgaagcatagttacgttaaaattctgtccgaaagagttggttgcaagatccgttttgatcattccatccggtgactgcaaaataccaaccgcctcacccggaagatcaattcccgtatactgaccgaatccaaaaatactctggtacttacagaattcttccggtccgattgccagaccaatctgcatcagggcaacgttacatgaattttccataacctgtgtcagattctgctgcccgtgtccaccattatcataagagatacatttaatctcccattcatcgatctgaagggaaccaccgcagtaataggtctcatcgcctttcagtgcaccaatctccagacctgttgcaaccgtaaatggtttgatcgtagatcccggctcaaaagtatcgctcacgcagaagtttctccagagttcattcagagcatcgatcttatcgtcactgctcattccggttatttcttcctctgtataatacttggatagatctctcggattattcaaatcataggtaggtgaggaagccattgccagaacttctccggtattcgggttcatcatgatcacagctccgtttttaaatcccatcccctcctgcgcttcatctgtgtgcgcctggttaaactcttccagatgcttttccacgatagactgcaggttcgcatcaatcgttgttacgatcgtatttccatttatcggctctttcaccgtgttttcaattgccgagtcttcattctgataaccatatctgcgtccatccgttccattcaacgttgaattataggatgcttccagtccgcttgctcccacattccccgatacgctgaatcccaggacatcgcaggcaagtgtattatatggatattttctgacataatcctcttccagccagattcctttgatcttggaatttttcttctctgccgcttcaaatgccttcgcatcatcgtaggaaattccttttttcagaatattgtaccgactgtccggactgtccgcgataattgcatccactgccgatgccttgatctgaaaataacttttcagcgcttttttcgtagctgctatgttttcagctttttttgtctcgtctgaaagtaagacctttgcatccagaatcacattgtatacacgctcacttgtcgcaagctttgtgccgtttgtatctacaatatctccacgcttgaacggaatcgaccgactcatatactgctgctgatccagtactgtcttggtataatcttctcctgacgaggcattgatataggtaattcttccgacaagaataacaaaagccagtaatatcgctataaagagcattaccagctttttctgcattccaaccgtgaatttatgcctcagaacggaaggctttctttttcttctttttgacatgttattcacctttgttcataaacctatttatctgttgtctgtccaagcactccgcttttcggaatactttcgtactgttttacataatcattaaccgggttctgatattcaataatctgatccgaagtcgcatatcccatacccagatcattgattgcacggtctcttacttcttccagattcacagaatccattactacgttatatctagttgtattctcttcttttgcatctgccagttcctgctgcagctcggtaatatgctctgtccggcttgtaagctctgcacgtacctgcagataccatacacagactacaagtgctgccactgccgcaattgaaagaaacatcacatatgcaggattcatccgcattgcttttcttcgatttttcaaaatctgtctgtccagttttttctttttatgttcttttcttggttcctcttgtcgctgtggcatgacttctgcctggcgaactgtatttccgtatatgtacattcctcggcttgttactgtacgtctgtctgcctgtattctatgactgtattttgccatacagcaccaccctttcaaattctatacgcgctcaaagatacgcagcttcgcactcttagaacgactgttcacttccatctcttcttcacttggaagaatcggttttttcgtaatgacttttcctttggaaacttttccacacacacataccgggaaagtactcggacacgtgcatggattctcattctttttaaaaatccctttgacaattctgtcctccagggaatggaacgtgatgatgcatatccttcctcccggatttaaaatatcaatcatatcgtcaagtgaatccctgagcacctccagttcccggttacattcaatccggattgcctgaaaggttctttttgccggatgccccgacatcttctgaaacttcatcggtatagactgtctgataatctctgccagctgcccggttgtttcaataggacctttctctcttgccataacaatatgttttgctatattcttcgcaaatttgtcctcaccatagtcgcgaatgatccgaaaaaggtccatctcactgtaaccattgacaatctcctttgcagataaagtctggcgtgtgtccatcctcatatccaaaggcgcatctacgcgataggaaaaaccacgatctgccgtatctaactgataagatgatacgcccagatcgagtacgattccatcgaccttgtcaatccctttctcatggagcctcgacttcatatcacaataattgctcctgattattgtaactctctccccgaagtcgcttaatcgggtgcctgccgcttcaatcgccgccgcatcctggtctattcctataaaactccccttgttgtttaaacgccgacatacttcgtatgcatgtccgcctcctccaagtgtgccatcaacataaataccgtccggcttgatgttcagtccttcgattgtctcatccagtaatactgatttatgcttaaatgccatggtgtcctcctaattaaaagatctatttagatgctaagtcccaaatcttccatgtcacttgcaatgtcctcgatattttcctcaacatcagctgtacgcgcttcccacgcctctttactccagatctcgaccttgtccagcacacctgctagaacaacctctttttcaagatctgcataagcgcgaagagaagaagatatcaaaactctcccttgtttgtcaagttctccttccgtagcacttccaagaaagaaacgcttaaagtctctggcttttttgtttgtaagcggtaaggttctaagcttctcttcaaaggctttccattcgttgtccggatacagaaataagcagccgtccatccctttcgtaattacgaaatgttctcccagactctctcgtaatttggaaggaataatcagcctgccttttgaatcaatactatgattaaattctccagtcaacataggatcaccttctttcaaagtggtctgccactttccatgccactttgctccacttcgctccactttctaccacttgtatccattgtaccccacttttccgcccttttcaagcactttttcgaatttatccattctgaaaaaagtccgataaatcatattttttcccatttttcattcattttgtggtgaaaagtggagcgttttatactccattccccacacagtgcataaaaaaagtggagaaaccgttccacaatggaaccatctctccactttcttcttttcatctactcagcagtgttaagtgactggatataatcacttacagcagaataatcaacttctgctactgctcttggctgctttgattcatacatatcataagcggaccatccaatccagacaacgattgcaagtgcaatcagcccaaggatcgtataatcaaaagcttttcgcaagtttttctttttttcttcacgctttctgttcgcttttgcctgtttataataatctacttttttctgactcatatctgcaagtctcctttgcaatcatctaaccagtacattttatcacacttttacgattgatacaagctatactgcaataattactccgccatcattcgcatacatgctactgacgcctctggtatccagaatgataatgtcttttaatttcacacgttcttccaacatcttcttcacatcctgtgctctctgcgggcagttacaatgcgaaattgcaagtaccttgctctccggatctttcagatctgcgatcacacaatccaccatattcttaagtgcttttttaattccgcgcgcctgacccaactgacaaatctctcccttcggagtagcccccatcaccggcttaatattcaatactgttgccgcaattgcttttaatcctgtaagtcttccattcttacgaagagtctcaagcgtctcaagaacaaaatatgtgtgctgctcttcaatatatgcttctacagcagctaccacttccttaaatgtcatgccccgctcttcacactgcgcaatcttcatcccgatgagcgtctgtcctactgatgcagattttgagttgaacacataaatatctttctcaccatattcttcttcatataaattcttgcccagtacggcactgttataagaaccgctcagttcagaagacaacgtaacagcgtatacatgctccgcatcacagtgatatccttccataaacgtctccggagacggacaacttgactttggacatgtcgggcattcagctacgttcttcaaaaattcagcctgattgaaagattcatcatcaattatatgacaatctccaacctccagtcccagtgatgctgtctcaaaccgacctgaagctttcatctctgctgtcaattctccacagctgtccacaatcactttataactcataatccaaacctccgaaacgtgtcatttgcatccattatacgtggttttcattaccacttataacatcatatcacacttttctttgaaaaaaaagctttttttacccttccagtttaattcttctggaaattccaagtgccattcccatttctatcatcaggaacaggatggatgtaccaccataactgataaaaggcaatgtaattccggtattcggcatcatgttcgtaactaccataacattgagaattacctggatcgcgatatgtgacataatccctgtcataatcagtgctccatacagatcaggtgcgttctgtgcaataaaaagcagtctgtagatcaaaagaccgaacaaaaccaggataatgattgctccaaacaccccaagctcttcacagattgctgacaggatcatgtcgttctgcacttccggtattaccgtcttttgcacaccatttcccagtcctttcccgaaaaagccacctgatccgatcgcatatagtccctgtaccgtctggaaagaaatcgttgacgcatatttttccggattcagccaggcaatgatacgtctgagtcggaagctggtgctgttctcaagaagtcttccgaggatatatgatcccgccacaaaaacagccagcccgccgcctgcaatccacagaaaaatcttctgcttcttatgtacgacaaaaaggatacagcaggaaattcccattacaatgatcgcagagcttagattatcagtcagcacataaactcccagtgctgccaaacctccccactccacaactcccagcgatcctttcagggtgtgtactttattccccattctgcagatcaggtatgggataaatatgatcacagcgatcttcataatctctgccggctggaatgactggttagccggaagccggaaccatcttcgtgcaccatttacctcaataccaagtggtgtaaatttaacaagtgcaagaagaagcatggatccccagtagctcattgctgcatatttggaaaacatatgataatccaggcgagaaacccacatcatcacaacaatacttccaagtccgatgaggccctgccttttcaggaagtacatcccatctccgtattccgttcgtgcttcataggaactgatactgtatagcattaccagtccaaaacacatcagaaatataataatcgccagaagactgtaatcaaaataatgaaccgcctgcttttttacagccttccttcgtctgcttttaattctttgtgccatttattcacactcctacttaagctataactacaaagtctatatcttataaagtataccataatatcccccagacgcacaagctttccgcacgaaaatagagcaggctaacttctattcgatttgtatacaaaaaaatggtgccgcttctttgcggcaccatctttgttttaccagttattctttattttttagcagcaactgcttctttgatctgtttggtaagttctggtacgatcttattcagatctccaacgataccatagtcagctacatcaaagatcggagctgtctcatctttgttgattgcaatgatcagatcagattcttccatacctgctacatgctggatcgctccggaaataccgattgcaaaatatacctgaggacgaactgtctttcctgtctgtcctacctgaagatcttttggtttccagccattatctacaactgcacgtgagcagcttacttctccgccaagtgcttctgcaagatcttccaggatcttgaagttttctgcacttccgactccacgtccaccggatacaagaatcttggcatccatgatatcaaccgtctcagatacagatttgacaacttccataatctcaacgtatttattatccggtgtaaatcctggattaaactcttctacatttgcctttgcaccttcgatcttagcgatcttctgcataacaccaggacgaacggttgccatctgcgggcggttatccgggcaggcgatggtagcgatcgtgtttccaccaaatgccggacgagtcataagaagctgattgtgcttctgctcttttcctgctaccgggttgatcgggaaatcaccgatctcaagctgtgtacagtctgctgtaagacctgtctgtactcttgcggatactctaggaccaagatcacgtccgattgcagttgcgccgactaacatgatctccggtttatatttttcgataacagatgccagtgcatgtgcgtatggctctgttctatattctttcagttccggatcatctactacgattactttatctgctccgtatgctgcaagctcatctgcaagtccttttacgtcagaaccgatcagaacggctgctacttctgcatttaagtctgctgcaaggtcttttgcttttccaagaagttcaaatgcgattccgctcagtttgttgtctacctgttcagcaaagacatatactcccttatattcttctaagttcatgatattcaccacttttccttcttattaaatgatatgtttctctgttaattttcccatcaggtaagatactgcttcttccggatcaagagtaactttttctcctgccccttttcttactttgtcagatgctttcgcaatctttgtaggtgatcctgcaagaccgatatttgcatcatccaaggtagtaagatctgctcttccccatgttgtgatctcagcatcacaagcatcgaagattccgcctggtgtcatataacgtggttcatttaattctgaaagtgcagtgataaggcaaggcatttttgctttcagtacatgatatctgtcttcgaactgacgctgtacgatcacgctgtcgccttctactttgatatcctgtgcataagagattaccgggatgtccagatgttcggaaatctgcggtccaacctgtgctgtatcaccatcgattgcctgacgtcctgtgatgatcaggtcataatcgagtttacggagtgctgctgcgatggtgcttgatgtagcccatgtatcagctcctccaagtactctgtctgttacaagaattgctttatcagctcccattgcaagtgcttcacgaagcacatcggctgcttttggaagtcccattgtaagtacagttacttctgctccatactggtcttttaatctaagtgcggcctcaagacctgctttgtcatccgggttcataattgcaagcattgcagctctgttaagtgtaccgtccggattaaactgaactccgccttttgtatccggtacctgttttacacaaacaactatcttcacgattcgtacctcctatttcaataagtttccagaaataaccatacgctgaacttctgaagttccttcgtagatttctgtaatctttgcgtcacgcatcatacgttctacatcgtattctctgatgtatccgtatccaccatgtaactgaacagcctttgtagtaacttccatcgctacttctgctgcataaagcttagcctgtgcagcttcgacagagtaaactttctgtgtagcttttgccatggcagctttgtataccatcatctttgcagcctctacctttgtagccatatctgcaagctggaactgtgtattctggaactgaccaatcgtgcgtccgaactgttttctttcttttacatatgcgattgttctgtcaagtgcgccttcagcgattccaagagcctgagcggcaataccgatacgtccgccatcaagagtatgcatagcgataccgaagcccttgccctgtgctccaaggagattttcttttggaatacggcagtcttcaaaaataagctcgtatgttgaagatccacggatacccatcttcttctctttggttccgaatgtgaatcccggagtgtctttctctacgatgaatgcagaaatctctttcatctttctgccacgtttttcaacaatacctgttacggcgataatgatgtaaacatctgcttctttaccatttgtgataaagcattttgatccgtttaatacccattcatctccgtcgagaacagccttcgtctgctgtccctgtgcatctgtacctgctcctggttctgtaagaccgaaagctccaagctttcttcctgatgcaagatccggaacatattttgctttctgttccggtgttccgtatgtcaggatcgggtcaatacaaagggaggtatgtgcagatacaattacagatgttgtagcacaaacctttgcaagttcttctacacacattacgtatgtcagaggatcgcatccctgtccttcgtattccttcggtaccggaataccgaggaatccatatttcgccattttttcaactgttgctcttgggaaaacttctgtttcatccacttcctgtgcaagtggttttacttcgttttctgcgaattctttaaacagagttctcgccatttcgtgtttcttatctaatccgaaatccatttattcttcctccatgtctttatttagaacatccattactgtgcatcaaccggagtttttgtgcggtctgcattgtatacatagaatccttttccgctcttaactccaaggtttccaccacggaccatcttacgaagcagcgggcatgcacgatatttgctgtcgcctgtttctgcataaagtacatccatgatagcaaggcagatatcaagtccgatgaaatcaccaagctccagaggtcccattggatggtttgcaccaagcttcattgctgcatcgattcctgcgatatcagatacaccttccatcttgatgaaagctgcttcattgatcatcggaacaaggatacggtttactacgaaacctgctgcttcattaacctgtacaggtgtctttccgatttcttctgcgatcttcttgattgcatctacagtttcagccggtgtatttacgcctgcgatcacttctactaatttcatacggtctgccgggttgaagaaatgcataccgatcattggacgggtaagtccgttgccgatttctgtgatagaaaggctggaggtatttgatgcgaaaatgcattcaggttttgcgatcttatcaagttcaccgaatgtagttttcttaacttccatgttctcaaatgctgcttctacgatcagatcacaatctgcgcagagatcttctttgagtcccggagtaatttttgcaagaattgcatcaactgcttcctgagttaattttcctttctgaacaagtctgtcatagcctttagcgattttagcttttccgccttctgcccattcctgtttgatgtcacagagtgctacttcatatccatctacctgagcaaatgcctttgcaatgccctgtcccattgttcctgcaccaataattcctactttcattgaaattacctccattttataaatttaattttctaggggagagttaattctcccctttattaaacgaacttatttattaaggaaagcttctacttttctcttttcaaggaatgctgccattccttctttctggtcgtaagattcaaagcatccgccgaagagcttttcttctactacgattgcctcatccattcccttttcaagaccttcattgattgcctgtttgcagtgtcttactgcgatcggtgcattctttgcaatgcctgctgccatcttctttgctgccggcatcagttcttcctgcggatatacggcatttacaagaccgattctgtaagcttcgtcagctttgatatttcttgcagtgtagatcatctgctttgccataccaggtccgacaagtcttgcaagtctctgtgttccaccaaatccaggtgtaattccaaggccaacctccggctgtccgaatactgcattgtctgaacagatacggatatcacagctcatggagatttcacatccgccaccaagagcgaatccattaactgctgcgattaccgggatcggaagtgtttcgatcttacggaaaatatcatttcctttcttaccaaaagcttctccctcttcttttgtaagagtactcatctcagcgatatctgcaccggctacaaaagatttttctcctgctcctgtaaggatcaggcatctgactgcatcaagatcaacaccgtcgatcgttgcatcaagttcatcaagaactgcactattcagtgcgttcagtgcctttggacggttaatggtaataattccaacctgtccttctacttcatatgtaataaattccatcatcaacatctccttttgatctggtttattaatcacgttctacgattgtagcgcatcccattccgccaccgatacaaagtgttgcaagacctttctttgcatcacgtttctgcatctcatgaagaagtgtaacaaggatacggcatcctgaagctcctactggatgtccgagagcaattgctccaccgtttacatttactttatccatgtcgaatttcagatcatgtgctactgcaagtgactgtgctgcgaaagcttcgtttgcttcgatcagatccatatcatctacagaaagccctgtcttagccattactttattcgtagctgcaaccggtccgacacccatgatagatggatctactccgccgagtgctcctgctacccatgttgccatcggtgtaacgccgagttcttttgctttttcttcactcataacaacgattgctgctgctccgtcattgatgctggaagcatttgctgctgttacaataccgtcttttttgaatgccggacgaagtcttgcgattccttctgctgttgttcccggacgcggtccttcatctgtatcaactacgatggtttcttttttcttcttcacttctacaggaacaatctcatctttgaattttcctgcttcgattgctgcgcaggctttctgctggcttgctgctgcaaattcatcaagctgttctcttgtgagtccccactgttctgctacattctcagcagtgattcccatgtgatagtcattgaatgcatcccaaagtgcgtcatttaccattgtatcaatcatcggtgcattacccattctgtatccataacgtgcgtttttcagtgcatatggagccatagacatattttccataccgcctgctacaacgatatcagcatctcctgcctggatcatctgtgcagccatgttcacacagttaagtccggatccgcaaacaacgttaaccgtaactgccggtgtctcgaccggaagacctgcttttaaagaagcctgacgtgcaacgttctgtccaagacctgcctgaattacacaacccatatatacatgatcaacctgttccggagcaacacctgctctatttaaagcttctttgataacgatagatcctaattccggtgccggagttgtagaaagagctccacccatacttccgattgctgtacgacacgcacctgctaacacgattttctttgccatcactttttcctccttttacatcttaatggtaagtatcacttcttattaaatatatactgttttactttccgtttttaagattttcgcaagggacttttttgtcctctttttttaatatactacccatttcccgttctgtcaaatatttatcaatcattttttatcatttaattttcttttaacattttcaccaacattttttcacaatacatctgcattattcgtcatttccaacacaccacttttatattgacctttcccagatatggtgctacacttaagattgttaaaaattattcaaccagaatactataattaaattatgaatgagaaggtgtgaaaatgagcaaaagttttgaagaattaatctcaaaagcaaatcaaaaaaccttaaagaaagtctctgtttccaacgcacaggatgagccggtactgcaggctgtcaaagctgcaaaagagcaaaatatcgcaacagccatccttgtcggtgatgaagccaagatccgtgagattgccgcttctattgatatggatctgacagatttcgagatcatcaatgagcctgataccaaagcagctgcattaaaggctgttgagcttgtacacaacggcaaagctgatatccttttaaaaggattgcttgaaacaaagacattcttaaagagcgtattgaataaagaagtcggacttcgtaccggaaagatgctgtctcatgtatgtgtatttgagattgaaggcattaaccgtcttctgttcttcacagacgtagctttcaatacatatccaacccttgcagataaagtcaatatcatcaacaatgcagtagaagtcgcacatgcatgtggcatcgaatgcccgaaggttgctcctctgtgtgcagttgagacagtgaatccaaagatgcagccaacagtcgatgccgataatctcaccaagatgtacgagggtggcgatttcaaaggatgccagatctacggaccactttccatggatcttgcgatcgatccggaagcagctgttcacaaaggtgtgactaatccagtagccggacatgctgatattctcctcttcccgaatatcgatgcaggaaatatcacatataagattcttgtccgcactgcaaaggtcaagatcggtaacgtacttgtcggaacaagcgctccggttgtacttacatcacgttctgatgatttccagacaaaactgaattctatcgctcttgcgaccgtaatcgcaggatcgatcacagactaaggaggatctttttatgagctataaaattttagtaatcaacccgggatctacttctaccaagatcggtgtgtacgaagacgaaactttgttattcgaagaaacactccgtcattccaccgaagagattgcaaaatatgcaaccatcgttgaccagaaagatttccgtaaagaactgatcgtagatattctcgcaaagaacagcttcgacatcaaatctctgaatgttgtagtaggacgaggcggacttttaaaaccgatcccaggtggaacctatccagtatctgacgcacttcttgctgacttaaaagcaggtgtgcaaggacagcatgcatcgaaccttggaggcatccttgcccgcgaaatcggtgatgagatcggagttccttcttacattgttgacccggttgttgtcgatgagatggaacctgttgcaagatattccggaatcccggaacttccgcgtatcagtatcttccacgcactgaaccagaaagcagttgccaaacgctacgccaaagaacagagtgtatcttatgactccctgaacctggtcgttgtacatatgggcggcggtgtatctgtcggtgctcataaaaatggcaaagttgtcgatgtcaacaacacgcttgacggagacggacctttctcaccggaacgttccggcggtgtaccggcaggcgcactcgtaaaaatgtgtttctccggtcagtacacacaggatgaagtatataaaaagatcaacgggaaaggcggtctcaacggataccttggaaccaacaacatgcgcgacgttgcagaacgtgcctttgaaaagggtgacgaagaagcagccggtgtattccacgcattcacttaccaggttgccaaagaagtcggcgccatggcagccgtacttaacggcaaagtagaccagatccttctcaccggcggtatcgcatacagcgattatgtaacatccgagatcaaggaaaaagtcggattcatcgccccaatcaccgtctacccaggagaagacgaactcctcgctctcgcccaaggcgctcttcgtgtattaaacggcgaagaaaaacctctggtatattaatttttttcaaagccctaaaacatgcaaaacgcatatatctcatcgtagaaaaaagtctggcacacctcgccagacttttttagttactacgcttttatttaataatgtcaatagcttcgagggacgcattatcttttgcccaatttgtcaacacaacctaaatcattcaaaaaaagagcggacactaaaaaagcatccacccttttttctatccctaatctcttttaactacagcagagcatcccattccgccaccaacgcaaagtgttgcaagtcctgtatgtacatcttctttctgcatctcatacaacaagcttacaaggattcttgcacctgagcagccaaccggatgtccgagagcaattgctccaccgttcacattcagcttactaagatcaaatccaagatcttttccaacagctacagactgtgctgcaaatgcttcgtttgcttcgatcagatcaaaatctccgatctccattcccagcttcttcataactttacgtgttgaataaaccggtccgattcccatgattgccggatcacatcctgcgagttctccgccgatccatgttgccataggtgttacgccaagctcttttgctttttcttcgctcataacgataagtgcagctgcaccatcattgattccggatgcgttacctgctgtaaccataccgtctttcttaaatgcaggacgaagttttgcaagaccttcttttgtgattcctttacgaggaccttcatctgtatctacaagaatcgtttcttttttcttcttcacttcgaccggaacaatctcgtctttaaatttaccttctgccattgctttttcacatttgttctgagaccatgctgcaaattcatccagttcttctcttgtaagtccccactgttcgcagatattttctgctgtgattcccatatgataattatggaatgcatcggtcagaccatccttgatcatagcatcttcgattgtcgcatttcccatacgatatccataacgtccgtttctcaacatgtacggagccattgtcatattttccataccacctgcaacgatgatatctgcatctccagctgcgatcagcttcgctgcaaggtttacacagtgaagaccggatccacaaagtacgttgatagttgttgccggtacttcattcgggattcctgcatatacagctgcctgacgtgccgggttctgtccgttgccagcctggataacatttcccatatacacttcgtcaacctgatccggagaaacacccgctcttttgagagcttctttgattacgatcgttccaagctctacagccgatgtatttgcaaactgtccgcccattacaccgattgctgtacgacatgctcctgctaaaacaacttttcttgccatgataaaaatcctcctttattttgtaaatcacctgatgtttttattataatcctctaaaaaacagaattcaatagatgcttgatatttttttaacatttttatgttctattccaggtatatgcctcaattcgattgagagatttcttgataaatgttaagcttttctcggtgtttatacttattgacactcacatcattattatgtttttttcaaaaaaacaattttgtcattgacatttatatagcaatttgttaaattaaagttgctcatatgactgacggaagtggaatgaaccacagggaaatatgaggatttgattatttagccgaccgtctgggcgattcagctcagatgccggctttttttacgcatttttataagattatcataaatcagggctatataaaaggcgtaaacatccatcggttcttctggctgaaccttttcatatgtctggaatttgccagaactttccgggcataaaccgcagcaacacagtgtataataaccaggtcataggtactatggctcacccacaagaaggaggaataaccaaatgatgcagaaagaacaatggcagggatttgaaggaagactctggaaagaagaaatcaacgttcgtgattttatccagaacaactacacaccttacgagggagattcttcattccttgcagacccgaccgaagcaacaaaccagctctggggcaagcttcaggaactccagaaagaagaacgtgcaaaaggcggcgttctggatatggaaacagaagtggtatcttctcttaccgcttacggtccaggttatatctgcgaagaactgaaagataaagaacaggttgtgggtcttcagactgacaaacctctgaaacgtgcatttatgccgttcggtggaatcaaaatggctgaggaagcatgcaaaacttacggatatgaaccaaacccgaaattccataaaatctttacagattatcataaaacacataaccaggcagtatttgatgcctacacaccggaaatgaaaaaagcacgtcacgcaaaaatccttaccggtcttccggatacttacggaagaggacgtatcgtcggcgattaccgccgtgttgccctctacggaatcgatcttctgatcgccatgaagcaggatgaccttgcaaactgcggatatggctctatgcgtgacaacgtgatccgacaaagagaagagcttgcagaacagatccgcgccctcaaaggcatgaaagaaatggctgctgcctatggattcgatatctccgaaccggctaagaacgcaaaagaagcattccagtggctgtacttcggataccttgcagcaatcaagactcagaacggagctgccatgagtgtcggacgtgtatctaccttccttgatatctacatcaagagagatatggaagcaggaatccttaccgaagaagaagctcaggaattagttgaccatatgacaatgaaattccgtatggttaagttcgcacgtatcccatcttacaaccagctcttctctggtgacccggtttgggctacactggaagtcggcggaatgggacaggacggacgttctatggtaacaaagacagactaccgtttcctgcataccctggaaaacatgggaccttctccggaaccgaacctgactgtactttacacagaacgtcttccgaagaacttcaaggactacgcttcacatatttctattgaaacaagttctatccagtatgaaaatgatgatgcaatgcgtccggtatggggcgatgactattctatctgctgctgcgtatctgcaacacagacaggtaaagaaatgcagtttttcggagcaagagcaaaccttgcaaaatgccttctttacgcgatcaacggtggtgtcgactgcaagtcaaaagatcaggtaggaccggcttacacaccgatcacttctgaataccttgattatgatgaagtaatggctaaatacgacaagatgatggactggctcgctggactgtatgtaaacgtactgaacctgatccagtacatgcatgacaaatactactatgaagcatctcagatggcactgatcgataccgatgtacgtcgtacatttgcaacaggtatcgcaggattctctcatgtagttgactccttaagtgcgatcaaatatgcaaaagtgaaaacaatccgtgacgaaaacggactcgttgtagatttcgagacaaccggtgatttcccgaaatacggaaatgatgatgaccgcgcagatgatatcgcagtatggcttcttcagacatttatgaagaaactgaaaaagcatcacacctaccgtgaatccgaacctacaacttctatccttaccattacctcaaacgttgtatatggaaaagctaccggtgctcttccggacggaagaaaagcaggcgcaccgctttcacctggagcaaacccaagctacggtgcagaacagaacggacttcttgcttccctgaactccgttgccaagctgccttacgaatgggcacttgacggaatctctaacacccagaccatcaacccggatgcaatcggacatactccggaggagcgcattaacaacctggtaaatgttatggacggatacttctctcagggtgctcaccatctgaacgtcaacgtattcggaacagaaaaacttcttgacgctatggaacatccggaaaaagaagaatacgcaaactttacgatccgtgtatcaggatatgcggttaagtttatcgaccttacacgcgaacagcagctcgatgtgatcgcaagaacctgccacgatcgtatgtaattaccgaacttacactcttttgccaaacatatcgttatgctggaagtcatgcattttaaaatgcatgactttcggtacatacagagatgctgctggcagcttttcctgcatactaaggcatttaaaagactctgcctgatccgcagttttccaatcacacaatgaaaaaggagattttcatatgactcaaatcaaaggacttattcactctacagaaagctttggttctgttgacggacctggggtacgttttattatatttgttcagggatgtccactgagatgtcagttctgccataaccctgacacctggaatatgacagataaaaacggcgccacctggcgcagtgccgatgagcttcttgcgcaggctctgcgttaccgcacttactggaaaaatggcggtggaatcacagtaagtggcggagaacctctccttcagattgattttctgttggatcttttcaaaaaagcaaaggcaaaaggtattcacacaacgattgatactgcaggcggtccttttaccagagaagaaccatttttctccaaattccaggagctgatgcagtataccgatcttcttcttgttgatatcaagcatatcgatgaaaaatctcacaaagagctgaccggaaaaacaaataaaaacattctggatatgatccgctttctctccgatatcaaaaaacctgtctggatccgccatgtactcgtaccggagcgcagcgactatgatgaatacttaaaccggttaaatgattttatccagacacttgataatgtagaaagagtagaaatcctgccttatcacacacttggtgcctacaaatggaaagagctgggacttgattatcccctcgaagggatcaatccaccttcgagagaacgtgtggaaaatgcaaagaagatcctgcactgttcgtaaaagttactgttcacagtacctgtgaccagcaacgcataagacacattttaaaaaaatagatgacagctttctcttcatattttacctgtaatgtgctatgattggtgtagtgtatttaagagaggagcattatagcaatgaacgaaagaatggaacgcgtattggaaaaaatgagaaaaaaaggaatcgatcagttacttgtatctgatccactcagcatccgcttcttaacaggcatcacggtaaatcctggggaaagattatatgccctgttgcttcgtacaagcggaaagcacacgattttcctgaactatctgtattatgtttccaatacaggttttgaagaagtatggttcagcgatatggacgatcagattggtgttctgaccaggcatatcgacaccaaaggcgtactcggtatcgataaagtatttccggcacgttttcttattccgcttcaggagcgctgccctgagctgaagaccgtatggggatctgactgtgtagatggtgtccgcgcagtaaagaatgccgaagaaattgaaatcatgaaacattctacagaaatcaatgatctggtaatggaacgagctgctgcttatatcaaagaaggtatgaccgaaaagcagattgctgattttatcgatgcagaatacctcaaagaaggtgcgagtggtgtaagctttgataccatcgtatgtttcggtgcgaatgcagctgaccagcatcatacaccaagtgagacaagaaccttaaaagccggtgaatgtatcctgatcgatatgggctgcgtatggcatggatattgttcagatatgacaagaactttctactgcaagagcgtagatgatgagcaggctaacattcatgatattgtccgcactgctgtcgaaaaggcagaagctgcgatcaagccgggagcacgtttctgtgatattgatgcacaggcaagagactacatcgacgaaaaaggctacagcgaatactggaagatccgccttggacacttcatcggacaggaagaccatgaatatggcgatgtcagcccgatcaataaaaatgtggctgaacctggtatgatcttctccatcgagcctggtatctatattgaaggcaagtacggcgtccgtatagaagacctcgttctggtaacagaggatggacatgaagttctgaataaggtagaaaagaaataccggattgttgggtaattaagtatatgacaaaaagaaacgcagtttgaatatccacactgcgtttctttctttttactctgttttaatatcaacaacttcatagacagacgctacatcttcctgataatccattaataataccaaatcgtatttattagtaaatgaatcatcatttctttttccttctactgttactttagcttccacatacccaatagttctttcattatataaagcttcacttgcttttttaatttctactgtaatattatctgtctgaattttactatctttataaaattcttccctctgctgctttattttttctctttctttatctgatgtaataatttcatataacttttcatctgttactttttttgtatcatcggaaaagctatcatcaattcctatagttgctttagcccagttttgaattccttcttctattttttgttttgaatcatctggaatttctttatctgttttttcaattttatcataaaaacttttcgtatcattattgattgttatttcgaattttttgtcttttttttcactttttttacttccgcagccaaaaatggtcatgatacttaaacaaattactgcacctattattaatctttttttcattttcttttccttaatataattgccagaagcatcttttccgacacctctggcaattaagtattaccttattttacttaagactgttcttattaacgaacgtgtctttttctgcaaattacagtaacaattgcagctgcacaaatagccattacaagaatgttcattactacatgagctgaatctcctgtctgaggtgtttctgcattttctgctttcttctcagcttttttagctttgtttgctgttttatctgcttttgtgttgtcaactttgctgttatttttgtcatcagctttgttgtcatcttttttagtatcatctggtgttgtcggctcagtcggatctgttggctcaactggatctactggatcaactggatcaactggatcaactgggtctacagactgaatcttttctacgatcattgtatgtccaccagttgctccaaatggaacctgaatgtttgttacctgatctacaccttctgcaagctgatagccttctggaagctggaagtcttctccaagcatgaatgtccatgcttcgccttctccacctactgctgttgtggatacagtcttagtatcaacaacttctccatcaactgtttcaaatgtgatagttaaaactgttcctactgtttctgctgggatcggttctacgatcattgtgtgtccaccaattgctccaaacggaatctggatgtttgttacctggtcaacacctgttgcaagctggtaaccttccggaagctggaagtctgttccaagcatgaatgtccatgcttcgccttctccacctactgctgttgtggatgctgttgtttctccaactttttctccatagattgtttcaaatgttacatttaatactgtctctacggtttctgaaggaactgcttctacgatcatagtatgtccagctgttgctccgaatggaacctggatatttgttacctgatctacaccttctgcaagctgatagccttccggaagctggaaatcttctccaagcatgaatgtccatgcttcgccttctccacctgttgctgttgtttttgctgttgttgtatcaactacttctccatcaactgtttcgaatgttacatttaatactgtctcttttacttcagaaggaattgcctctacaagcattgtaaatccacctgttgaaccaaatggtacttcaatgttggttacctgatctacaccttctgcaagtttataaccttccggaagctggaaatcttcgccaagcatgaatgtccatgcttcaccttctccacctactgctgttgtttttgctgttgttgtaccaactacttctccatcaactgtttcaaatgttacagttaatactgtttcctttgccggttcaactggatctactgtatcattaattggttctacaataattgtatgtccgcccattgcaccaaacggaatcggaatgtttgtaacctgatctacaccttctgcaagtttgtagccttccggaagctggaagtcttctccaagcatgaatgtccatgcttcaccttctccacctactgctgttgtggatgctgttgtttctccaacaacttctccatcaactgtttcaaatgtgatatttaatacagtttcttttggtgtaacatcactcttaattggttctacaagcatcgtgtgaccgccaattgttccaaacacaactgggataactgtaacctgatctacaccttctgcaagtttgtagccttccggaagctggaaatctgttcctaatgtgaagtaccatgactcatcccctgctcctgttgctccagtcttggcagtcgtttctccaacttttgttccatcaactgtttcaaatgtgatatttaatacagtttcttttgcaggatcaactggatctactgtaccgttgattggttctacaacaatttcagatgaagtcgttgctccacatggaagctgaatgttagtgttctgctcataatctaatcctgttgcaagctgatagccttctggaagctgataatcctgcccaagcatgaatgtccatccatcacctactgctgttgatgttaatgtctgagaatcaaccactgttccatccttaagtacaaattttaaatataatgtagttacagtctgctgaacctttttcacataaacatcttttgaagcaccgtcaaggtatggagcaacagatactgttgtagattctgtatatttaccatctacttcatatcctgatggcataatagaactaatatctacatcctgtgccactccttctttaccatttactaccatgtactgtggatcaccgacaactgcatcaccgttatcaacgtcatgaaatacaaacttaacgctaaaatccccatatacatcactagcgaaaacacttaatgaattaaccattaacatcgctaatgtaaggcatgcaacaaggatttttctcatactctttttcataaccttttttccatcctttcttaattttgagtataagtctctctcgtatgtcccccctttttattcaaattttcgcagaaactattttcctgcctgtaaaaaaagtttctactatttcaaaagccacccaacgcgtagagacaattattttcgccaaatgacttctgactttgacttcatttccgagaggttataccgccaatatctcctcttgtgtctattatctagttttcacattgcggcatattcatacactgttagtatacgtcttagtttttaagatgtcaatcgattgtgtcttaattctaagactttctgtgttttttctcataaacatcctccgtttttgttcactttgacgaaccgttaattgtttcattatcaaacccactcttttctagcttttttaatatttttgtcatgtattttattatttatcgaaacctgtcgaaaaacttcgcaccaataccctttagtcttattttttaagatttttattattaaaagtaccttttttaagactttccacttcctaacatcaatttccattataataggtaataacatatacagatttcgcttatactatataagaactcttagaaaggaagacctgctcatggaacatattggagaaattctccggacagcacgtgaagataatttttatactcagaagaaagtaatggaactgaccggtatcaaccgcaagactctgtccggctatgagaacagtgtagctgaaccagatcttgacacatttgccagattactccgcttatatcaactttctgcggatgaagtattaggaattaagacttctaccccccccccctcgcatttttccctttcgcgctgcgaacgaaaaatgcttactcttttccaaaaatttgacaccagccaccagaaagagcttttgattcagtttcaatctctcgcagactatctcgataaaaaatcaaaataaattgtcattgctttttcctgctctgaccatttataatgaacttatactatgtttgaagggggaacattttcatgaaagatattggtaaaattctgaaaaacgcccgtgagaataaagaatatacccagaaacaagtgatggaattgaccggtatccacagaaaatctctgtccggttatgagaataacgttgccgagccggatctctccactttcgcaacccttgccaatctgtatggcatctctgcagatgaagctttggaaattggtgaaccggatccttctgtttctttgcttcgttttgaattccaagttctttctttatttaaagaactcgatgcaaagcatcaggaagaacttctgatccagatcaccgcactcgtcagatatttaaatgcaaaaaatatggtgccgcaaaatcatcaatccagataattttgcggcaccaccgctttatacatgtaaattcttttccatttcctgatgcatttcttttcccttgaaaagcaccagtccgatcagcatcagcacgcccatcccaattgaaatcacagacggaaatacaattcgtaccttaccagtcagcaaaaagataaatggtaagatcattccgtaaagcgccgccatcacaaagtacaccagatagtccttcgcctgacggtaatacaccctcgatatgatcagcatcgaaatcataatcaagccactgactcccggaagcacaaagtcaatcgaccagccatgccagccggtcagccagtcccagataatacagccgactgtcacaatgatcagctgccacatggcattcttcagcagattataccgcttaaaaaatccaaccgcaagcgcaagccacatgctgaatgcacctccacaaacgaatagcgataaataaaatgtcttatcaatactataatccacgccaagtgccgttacgatagcgatcatgcaaaggaatgtaaatattttgaatatctgcatccccttcgcttctgtcatgacgctttccgggtattccaccttaaggatctccgttttcacttcctgttctttcagaatctggaaaaaattctctttgattgcatcacagtcatatctggacgtaaatcccagataaatcttatcccggaaggaacacatacaaagctctactttcggcgtacttgtataaacaccaaaatacctgatatacgtctcatagctttccggcatccggatgattcccatgttggaaaaaatagcggtcacatcactttctgccgtcctcgccccgatattgatacagacatttttcagttccagcggcgcaaatttcaggattggatgcacctgcaaggcgaagtaatcgttcatccgcttctccatcttttccgctgtcagttcttctttaaagcatgcatttactttttgcacaacatctgtgaactcttcttttccaccctgaaaatgatatcccggttcgatccagttgaagaaattgagcattgtattggtcggaaagaaattacgcagatttaccggaaccatcagtacaaccggcttgctttcctgccgtcttgtcattgtccggtgaatcgcacacagatataccgcagtaagaaataccgtcatcgatacaccataagtctttgcctgatgcctcagttcttcgaccggaatttctgcctctgtcgtctgcaggcttccaagctcacgccggtttccgcgaagctgatgcgctgccggttttttctcctttttgcggtctgcctggtgggaataatatctttcaaatccatctgcttcctgatcgaaaaggctctccgaatactctgacagaaccacattctccagtccatcctcatgatgtgccagatacagataatttttcaccagctcccgtacaaattcactggcaccggttccgtccgtcagcacatgaaagacctcaaaattgattctctttttgtaataagtcacttcaaaaagcagatctctcttatcacggatataaaggctgctgcacggctccttatactcttctcttacaaccggtcttttattactctgttccagataatgccagaacagtccctttcgcagcacggacagaaagatcggatatttttccagtgtcctgtctaccgccttctgcaggatctcctgctgtatatcctctttcaattcacagtagaaccggaatacacgggtatcccttttactgctcgccgccggaaaaagcttcgctgcattgtccagccttctccagtgctttacatttgtctgcggcattttctattccccctccagaaaatgattgatatattcaaaactttcctgtacatgcaggctccggattcccagtgcaaaatatccgtgaagtgcatccttgatccggtgtacttccacccggttacctgcctctgcaagacgtcttccatacgcttctccctcatcccggagcggatcaaattctgacgtcaggatcagtgtatccggctgtcctgacaaatctttctccagaatcggtgcaaaatatggatttaacttgtcctcttccgaacctgcataaagattgatataatcttttaatttgcctgccgtcagaagataatcctgcccgttctcccttacagaagagaacagactcttctctgaataatcattattgactgccggatagatcagaatctgtctctttggcataaattcgccacgatcccgtgccataatggacaatgcagctgccagattgccacctgcactgtctccaatcagagtaatatcctccggctttgtatccggatgcgtatacaatgctcttgccacggcatagcagtccataagcccggtcgggaacttgtgctcaggcgccaggcggtattctactgctgctacagtctgccccgtcgcctgtgccatccgggaacatactctctcataattttccacatgctcagtcgcccatcctcctccgtgaaggaaaagcatgatctttcgtcccttgatctgatctttttccagacacgatgcttcatccgggaaaaatacccggatcggaacttcataatcgccgttatatacctgcagatccatttttttataaaaaattttcatcggatccagtcttttcagatccgcaagctgccttgatacttctacatcaatccctccaaaagacaggattttcaggattgcttttgttgctatattgatcgccatatttttctgtcctcatttattttttcatacagatttattctaccatagaatgatgtcccctaccactctttctctttccatctttgctacattaacccattttcaatttttcaaatttcacaatcatctcattatttatttgacacagactgtcaaaacagttaccatacacttatgcacaaggagggtgtatttgttttatgaataataaaaaaaatatagacgactattttgatgacaactttgaagtaacttatacaggcgatctcccgtcgatccctgtggggcaggatgattatgacgaccggtatgacgacacagactaccttaacgattatgaaactgacgactactacgatgaaacagacaggcttgctcctgattatgacgatgattatgaagaagaggattcttattatgaccgccaaagaccagccagacagacagaacggagaaattcccgcagacgtcccgattcctcttccgaagaactggctgctccaatccggaatattgcccgcaccggaagtactgcagctgagaaactgaccactttcatccttcgcccggcaccggttctgatgtccgccatcatcctggcgattacctttttttcattctggaatcagctgtctgattatggagatatcaatacactgacatccaatccagatcttactctgattacttatctggctgtcggagcggttatgctgatctggatgctgtctacgttctttttcacattaagtggcatccggcacggaaccggacgcggacttacttattttgtcctggtatatgttctgtcctacctcttcagtctagccgcagctgcaattcctgctgatgttcagttgctgaccggtatccgaggcggtatcctggtatttggttctctttacccggcatattttccattctgcgtggtgggaattattacttgtattttgcggaaaattttgaagtaaaacattcctcatactaaggcatatgccttagggcatcctcatatggtgttttgctttataagtgaacaacaactaattacatacgaaaaaagagtaagtcaaatcactcatctatctgatttgacttactcttttcttacttttgtttcattcctgatgtgttttccaacttttgtactattttttctatatcatattccggtgcataggtattggcaatatcatagattctctgtatcgtcaagacatcctcttccagaaaatctgcaatttcctctgctgacatccctttttgcaatttttttataacaattgaaactaatgcttccctgtacccttctttacgcccttctttacgtccttctttacgcccttcttcatgaccttcttcacgtccttctcgcatcccaattatttttgcacttttcataaacgaattatgatcccacaaaattttttgtctttcttcgtattctcttctttttctttcatctgcactcatcttctccagacattcataagcttctttaatatattcattttgctctgccatctttgcaaaatcctttctgttctttccgctcataaatcgcatccactggatgatcccagtttcattctgacttttctactataaatattttaacatactgtcatcctttgtaaaggcaaactcccatacttctatattttcttttgctttgttcattgtcgggagtttactcgaaaattgagcaccgaaaatgagataccttctgattatggttaattagatactttttcgattttagaactaaatcgaagtaaaataactctatcacattttcctgaaatcttataccctgcataacattttcgagcactttcgttgcatttcaatcatcagaccattttatatgcatatccaaaaaaatcccgtactccatgtacaaatcacatgaaatacaggatctttttatttatctaactagaatttgataactccaagaattatacctgagatcagacagataatacttacaccccagatccagaagaaactgttcttgatgtgatctttgatctccacaccggcaagtccggttccaaggaaagtagcaggaacaaccgggctgatgaaagttgcacagttacggcaaacaaccattgcaatggcaatatgtgccggatttacaccgaattcgtttccgattccgatcagtaccggaagcattccgaagaagaaggaatcggtatcaaacatcagtgtaagcggtacagataccagacctacgataagcggtaaaaatcttcccatagactgtggaactacgtttgcaagtacgttagccatatgagtcatgatctctgtttgctgcatcactccaaggaatacacctgcacaaagaatcgtagatgccatggtaagtgccggacctgcatgggatttaataatcttaccctgcatttttgcacccgggtagtttacaaaaagtgctactgcacatcctaccataaagatatagtaagacggtacctttgcaagaaccaggtttacgatcactaccagtgttacgattacattgaatacaaagagtttcggtcttgcaagctcattcttttcatcatctgttacggcttcatcttcaattccgccatactcgatcttttctgctgaagaagtgcccgcacctctcttcttttcgatatttccccagataaatgctgttccaagtgcaataaaaatacctacaacctgcattggaatgatctgtttccacagtgcatttggttcaattccaaggacagtagccgcacgcattgtcggtccgccccatggcagaaggttcattacacccattgcagatacacagatgagcatcagagttgtcggtctcatattcagacgtttgtaaaccgggagcattgccggaattgtgatcaggaatgtagaggcaccgcctccatccagatgtccgatcatagcaatgatacaggtcatcatggcaacaccgactacattacttccgactttcttcatcaatgcattgatgatcttgtcgaacattcctacatctgtcataattccaaagaaaagtacagagaagataaacagcgctgcagtaccatgtactcctgctacaccggctgttacaaattcccccatttcttcaatcgtaaatgttccggttgctacaaggatcgcacctgttacagttgatacactgacaaatgcaagagccggtaccgttacatttcttaagagcaacgcaatcacaataatgatggttgcaaatcccaataaggcaagcattgcttcactcatggcattttctccttccttttgtacgggtactttttcgtaccatttatttgatgattccattataaaaacccaaccttacactcttacagattcctccttacattttgttaaggtaaatctttaaaagtattaaggttgggtttgtcttatcttacaccttacagatatctgcgtcttttttcttataccggctggctggcacaattccgaattgcctcaagaatcgcggtatccgataccggtttttctacatatccgtcaatgattcctttctgccgggcctctgccatctcacgattgactccatcaataataataagcttcagcatgtccggatatctgcctgcaagcgacatacagaaatccactccactgcaatcctccatcgtctcgtctactaccagcacatctgcctgctgctgttccagacatttttgcagttcttctcttttcatacaggtctgaatctggatcccgatcttctcaaaattctttttcagcagctgcaatacctttgcattgtcatctgccaccacgatccgataatcctttctgggaatattctgcacaatctgtggcatatgctctgtatccagtaccggaaggtagatatgaaaggtacttccttctccttttttgctctctgcataaatatatcccttatgtgaagtaataatctgctccgcaagtgccagtccaagtccggtaccctctcccccttttttcgttgtaaaaaatggatcaaaaatctgacgcagcgtctctttatccattccacacccattatctttcacctggatatggatatactttttccatacatccgaaagcttttcaatcactccctgagccagtttttctttttcttctgaacggcaggatattctgatatttccttgattttttccaatcgcatgcaccgcattaacgcagacatttaaaagcacctggttcagctgtgtcgcatttccaaggatcatttcatcatctacccgaaactcactttccatatggatcagaggcgtacagacagattccatcatcctttctgcacgcgtcatgaatttctttatcgaaatatttttataaacggtctctacattctttcgactcagggacgaaatctggcgcactacatcctttgctttttccgaagcctcataaatttcttttgcactgtcctgttcttctgatccttccggaagttccatcatcagaagctctgcatatcccatgatcggagtcagaaaattattgaattcatgtgcgataccacctgtcatagttcccatgatctgaagtctttgctgatgtgcgatactctgctcactccgatgcattttttccaactgctcattcagttctttcagatcattgatctcccgcacagctcttctcatatcacgcatcactctgccaaataagacaaccgcaataccggcagccaacaaaataccaacaaaaatacataccattttcaagaaaccttcagctatcggttcgtacagatcatcgtagtcgatcaccgcactgactacccagaagctgtctccgatctgaaccggagaatatgcactgattttctgtactctcggacgttcttcatttgtccaccaatacgaataataatgagaaataccttcttttctcttcttctgatcctcaatcatcttctccagactggagtaatccagatccggatacattttcttccttcctgcaataaccggaattccccactgttctttcttcggatgcatgatgatcgttccttctgcatctttgacaacaatgtatccattcgttccgatgtgaattcccgaaatcagtttctgataatatttttccgcatcgatcatcagacagatctttctcccatccttcaaaacacgcttatatacattatagattttcccacctatatctttttccatataaatgctattctttgccgagctttgagtgagcagctgtgaacttacaatctgtacatccttgacactctctgaaagctttccctgttcgtcttccaggtacagattcgtgataaaactggtctgtgtgtctataaattcccgatacagttgttttgcctcatcctgcggtctgttctctgctgttttcgcaagaaagcttaaactttcctcatattcctctgcggacatcgccatattttcactcaggattctggttgtcaggagcatctgttcctcctggttctgcatcaaagtatctctgtactttttccagacaccaaatcctgcaaatacaagaattacgattaaaaaaagtggaatcgcagcaatcagtgtctttttgtttttcttcatatattctcgtccccggtttgttatcaattgacttgttttctttctaatattataatgttttttataagttgtatagaattttattgaaatttttacttttgggaggttgcctcaatggctgacaaaatactgatcgtagatgatgatccggcaatctgtaagctgctggaaaaggtaatgcacagcaatgagctggaaacaacaacagtaaactgtggcatggatgctctgtccatcctgaaaaatcatacatttgacttgatccttatggatatcatgctgggagatatggaagggtttgaagttatcaaaaggcttcgcaatcaggggatcagtactccggttatgatcgtcagcggacgtaatgaagactatgattctctgtacgggctttcacttggagcggatgattatatcaccaagccgttccgaccgcttgtacttggtgccaaagtaaaagcactgatccgccgcaacaagaatctggtactcgacaattccgatactctggaatgcggtccattcagctatgataccacaaccatgcgtttttacaaaaatggcgaagaacttatcctttcttccaaggagtctgcacttcttctgctttttatgaagcatccgcagcaggttttcaccaaggatatgatctatgagcatgtctggggcaatacggttgccgttgatgacaatgcgatcatggtctacatcaaccggcttcgtggtaagatcgaggacgacagacagaatccggcgtatatcctgacaatccgcggactgggataccgttttgttccgtaaacgaccttttcatcaagaagaggctccatccggaatcttctcctaatgaaaaagatgacttttcacccgctcatttgtgaaaagtcatcttttttattcctcaccagtctggtgcagtccatattcatggcagaaaatttgattcccgttctcagttattatacgctctattttacaactggaaagaggttcaggattgccccgttctcgtttggaattttattgcacagcatcgcaagaaacagtgaggtggcaagtaaatcggcacacccacccgcgctgataccacgctttatataatccgcatccatgcggatcagtttgtctaacgcatcttctgagtaggctccgccttcctccagaaactgcatcgcttccatctgtacctgatagagtactgacggattctttctcgataaaatgttggaatcctgcacccggctcatcagtgcaaaaaggatctgtaatttgatccgattccactccattccccgcaaaagtccatcctccagtaccggaagcgcaatatgaaaaacagatggatatccggcaagcgcttccccgcgaatccctgtagtcccgtattgtacgagatttttctcaccgttacttttcgcaggttcctttcccaacatctcaatttcggctcttaagatcctggcactcatcttctgctccatccgaaggatggattgcaaagtagccgttccgtcttcctggatacatcttcccgctgccgcactgaatattccaagggtaaagatcatccctttatgtgtattcacatgtccggttgcccgatacatggcttcctccgcaagcattccggtcttacggatttcacggaaaagatcttccggcgtacaggtcagctgatatccctggtatgccattctaacaaaccacggatacaacgcctctgcacttctttcaaaggtctgcacatccatatcagtgtgggcaccacaggaatacggatctacaagccccggtttgggaaccgtatagacttcctcaagcagcgcctgatacgccatccggccaatcgattctgcaaagtattctgctttctctactgcctggttctttctcatacggttctccttttatatccaattgccaataacctgtaagttttctgatcagaatttaatcatcaaattcaaacggcttgatctgacggacaacatccatgatggtaccgtcacggctttcaatgacaccgacaacacgatctccaaactgtaccttctgtggttcccccgcgatagagtaagcgatatcacgtaattcttcgatggtcttaaacggaaggtctacatctttcattgcttcgatcagatcctgtctcttcggattgattgcaataccataatctgtgatgacaacgtctacactttctcccggtgttgtgacggttgttacgtctgtacagattgccggtgttcttccctgaagaagcggtgcgataacgatggcacattttgctccggctgctgtatccggatgtccaccctgcgctcctgtgatcataccattagaatctacaacaacgttacagttgaagtgtacgtcaacttccagagctgcaagaattacgaagtccaatttattgacaactgcacccttgttgaacgggttcgcatactcacctgcactgatccggaaatgatgcagatcttttacagattctacggctgcaaggtcaaagtcctgtgtatccagaagtgcatctacctgaccattgatcagaaggtcacacatcggctttgtaagaccacccacaccaaaacgcatgcggatatttctttctttcattacctttgcaagtgaaatagtagatgcgatagaagctccgccgacacctgtttgataagagaatccatctttgaaatacggtgtatttacaacgaactgtgtacagtaatcagccatcatcagctttctcatatctgtggtcggttttgctgcacctgttgcgatcttcttcggatcaccgatctggtctacttctacaacatagtctacctttgtcattgaaatatgtgccggaaagttcgggaacggaaccatgcagtctgtgattgctacgactttgtttgcatggaaagcatctgacattgcgtaagaaagtacaccacagtcagattttccaccgataccacggcagttaccgtactcatcacaggtaggagttccgataaatgcgatatcgatctgtgtctcacctgttaccagggcacgtacacgtccgccgtgggaacgcatgatcgcaagaccttttaatttaccattggaaatagcttctccgatctttccacgcacaccggatgactggatatttgtaatggttccatcttcaatatactctaccagaggatcatgtgcttttccaagagagcttgcacagatagtaatgtccttgatccccatatcatggatctctttcattaccatatttacaacgtaatccccttcacggaaatggtgatggaagctgactgtcataccatctttgatgccacattttacaagaacatcatggatactgtctaccatcttgcttccgttggaattgatcacacattctacttccggtccatgttttttatagacatgtccgtcaaaatgatgaacaccctgaaatacttctttaccagttgcttttaaaatctcttccgggatatctctacctactgcgttaatcatcttataaatcccccttatacacacctgaagcttttgcaagctcaattgttctctttgctccgtcatagaaagcgatatcgatcatcttaccatctactgtaaatacaccgattccctgtgctttctttgtatcaatttcacggacaactttttctgcgaaaatgatatctttctgttttggtgtaaagatttcatgtacaatgttgatctgtcttgggttgatgatggattttccatcaaaccccatcaggtggatattctcaacatcctgacggaaaccatccatatcatccagatctgtgtatacagtatcaaagcactgtacacctgccgctcttgctgcgatcaccatgttctgtcttgctcccatgagctcgattccggttccggtaatgtgtgtctgaaggtctttggtgtaatctccgccggaaagggcaattccgaaaagtctttcggaagattcgcagatatcaagtgcacgcatcacgcctcgtgcggattcaatagctgccatgatcagaacacttccctcttcacgtccgaaatctttttcagcctgaacaacttcagcttctaccacttttacgtcctgtgcggattctgtctttggaatacggatcgcatcacagccgcctgctactgcgcagcggatatcttctttccagtaaggagtgtccagtccgttaattctgacaacacgttcacatcctctataattaatcgtcttaagtgcatgataaagagaaaatctggctgcatctttctggttttctgcaaccgcatcttccaggtcaagcatgatggaatccggtttgtaaatataaggatctttgatcagtcccggtttctgtgcatttaaaaacatcatggttcttctaagtctttttttattcggattcattatctgatcgcacctccccacggtaaatcttcgatctgtcctaccgaacggtaaacagctgcttcgattcttgctttgatcgtacagtcaagagctcctttatctacgattgtaagctttacattatcgattcccagattttccagtgtttcataagctactttcttaatctggtttccatactgattgatcactgcgctttccagtgaaaaatcaacttttccttctccggcttctactgttacctggcagtcactggattctaatgttcctgcaattgcaggtttcttgatttccattcgcgcttcctccttaacatccatttgcattagtatttgcttcgttgtgtttatcatagggctcttaccttacaggaacacctatggttttcttaataattgttaagattcgcatatttttgctgttacaactggtctttccagtgcctgtgaattcatattcacccagcgtttcatatataccctgtcttctttccattcaaaagacacatgatcaaaaaaagccatctccggatagcgccattccatcatcaacacattttctgatttccagtaagcgcatgcggcaattttcatttcatccatctcatactgatggtgcagatatccacctgtcatagaggttttcccatgaatccaacagtccagtcctgcttctacaaaatgtgttcctctgttatctttcatccagaatattactttatcttctaaaaattccagacctgttttttctattttatcttcattctcaaaaggttccatttctattttccgatttcctgaaaccattttgttactgacagatctgtttttattttccagagacattctgagacctttattttttaatacattccacatcttttcagcgaaatttctttctgctttcatcggatccaaaatctctttttgaatcagttccgtctccaggtaattactgtctgccgtagtgatagcaattaccatattttgttccggaacaatcgcacaggtctgtccaaacattccatctgaacaccagatatctcctgtatgcgtccagtgaaaattataatctttttctcctgctttccttggttgtggatcttttttaccgagtgcaagattcacccaatcagcacttaataattgtttttctccccattttccttgattcagataaagtaacccaagtctggccattccttctaccgtaatgctcacaccatttccacctgaacagattccttccggactttctccccagctaaacttctccagaccaatgtacggtgccagttcttcttcgatcaattgatggcatgtttttcctgtaatacgctgtacgatcgctgacgtaatataagaattcccacttgaatacataaattcacttcccggctcttttacaaacggtactttaaaatatgcatccagccagctggtttttaatggtctccattcatttccacctatacttctttcctgtccactgcgcatcgtaagtaaattccgtatcgtaagcttctgaagatactcatttgctgcctcacgatattccggaaaataatcaagtaccttatcctccagctttatgagtccttttgtatatgcaattcccgccgctgtatttgtaaaacattttgtaaaagaatggacaatatgtgggatttccttccgatacggttcattatatgcttcaaatataactttattgtttctcaagatcatgattccatggatctctgcttctcttttttccatctcgttcagaaaattaataatatattctgatgatacgccttcctcttccggagttgaataggttaattctttgttcatgctgccacctcatctaactttattttaaactggaaacgggggacaaaattttgccccctttgttatacataactcttttctgtcttttaaaagaacgggaataccaatggaagaattcctacacagcatataaagctgataataaccaatggccatccaaattttgcaaagtcagtaaattttaagtttgtaaagatcattaatgtctgatttgttcctgatgcgatcggtgtcaggaaagagcatcctgctccaattgcaattgcaagaacaattgcctgtgggtttgctcccattgattctgcaatagagatcccaatcggggcaagtactcctgcggtcgccatattgttcataaactgtgttgcaattgccgatccaaggaacaatactgctgtgatcaaatacagatttttcgtatctccaagaatactcagcacaacagctccaaacacttccccaagtccactgttcttcataactgcaatgatcaaattgatacctgcacagaaaagtaccatatcaacaccgaatgaagtgattacttcttttggttttacaacagttgtaagaaccgaaaccgcgatcagtgcatatccgataaaattcgggttcactgtaatatctgtaagcgaatccagaatcagagcaagtacgaacagaaggaaactgattcctacaaccatctgtttctttttcatctcaggtgtaatttctgtagctgcctctatctctgaattgcttggcactgtttcctcataagacgggcaccagcggttcatcacgatcatataaattccacccagaataaaaatcggaatacctacccaggcaaaatcaaacatgccaaaaagcttaagtccagcttcttcaagcgccgtatttgcataaatatttgtcggtgttccaatcagggtacaagcaccacctaaagtacttgcataaattacaaacaaaatcatttttgaatgactgatcttatttttcttagctatactgaaaatcaccggcaaaaatgccattgcaacataactgttctgcagaacaaatgataccagtcctgatgcaagataaagaattgcaaaaattaacatttcttttttctttccacttacattaccggttaatttatctaaagcatttcccattacgatatcaagccctgttgcagcaatcattcctgaaaacatacatataattgccatcagatgaaaacttgaactgcttaacacggcatatactccgtctgcatccattgttcctgtaaatacaacgatcggtgccatgatcaaaaaacaaaaccagtttggtaattttggcgttgcaagaactgcaacgaaaactattaatgtcagaatcgctcctattgtagccatactcatctttcttttcctccgtatccatatacaataagctttttcggagtgcgcttttccaaaaactctcattcttctcttatatgatgtttaccggctcatcacgttaatcttattataattgtctgttactgttttcaccaatgccaaaagaaaataggggtatagcttcatgctatgctcctatttctccatttattattttctctttcaaaacagatatacagtacttttcctgtctggaaaggattttatttttcaaatatataatacctgtttttgtcttttttaccttgttttttccaatgcaaaaaaaatcaatatcttttgtatttgttatgtatggaagaaatacttctgatataaaacagaatcccattcctcgctccaaggtctgcattgcaagcatcgaactgtttacgatcatctttggcttcaattcttttccatattcttcaaatatctgatcgatctcttgtctgacataacaggaattgtcctggataataaactcattcggcatcatcgaaatatccatccatggatatttttcaccttctcttttttctgctttctgaagcatcatatacttctttggaactgcaagtaacatataatcttctacaataagatcaaatacgatagaagaatccttttcactcagatccggccctattgccaagtcataggtcctgttttttaagcctggcaggatttccttagccatgacatttgaaaatgttgctttacacccgatgtattttttactgatcttctcctgaacttccattaccaacaaaagactggcacttagagacatacatatgtgtatttcctgttcttcagataattgaagttcctttaattcatgctccattgtgctgtttaaacgtttgatttcttttccatactcaacataaatttcgccagcctctgtcagactgattccattcgatttccgctcgaaaagtaaaattccaagttcctgttccagactggatataaatctgctgagtgatggttgtgaaatatataaaagttcagcggcttttgaaatacttttgcattctgcaaccgctaaaacataggtaaacgattttaaatcatccatttttatcctcatcctcctgtgatctcactaaacagattatagacttttttatttcaaaagcgcaagacttacttttcctccataaaactcctcacagcaccaccttgctgtgaggatctctctttttctttatttcttttccttacacttccgtaagctcccctgtctccgaatccataatgaatcccttgatctcaatatccttcggcatcaatggatgtgtcttcagtgtatgcacagtctcttctaccgacttctccacagattcaaatccacccagccatttttccagatcaattccgctgtgtcttacgatatcaatatgttctttgtcgattccgcgctctaccagttctcctaacagttcatttccgtccattccctgcacaccgcaatccgtatgtccaatgaccataacctgctccaccccaagctccagaatggcaaccagaaggcttctgaccacacttccgtatggatgtgtaatgactccacctgcattcttgatgatctttgcgtctccgtttttcagtcccagcgccgccggaagaagctctgtcagacgggtatccatacaggtcagtacggcaagctttttgttcgggtacttgctggtcaggtacggctcatagcctttattttccacgaatttcttattatactctacaatctgttctatcatcctgtgtaacctcccatttgattttcacaacgatatttcataaaacagattatagactttttttctctgtaagtgcaaggattcttaatgaattttaatgatgttttttcttccagtactgaaaaaatgcctcctcctgctctgagcggattccatactttcttctcgcaatgtagaatttggaattccaccctgaagtcttcaccggaatcgtcaccacattgtgcagccgcacgatatccatatacggcaatacggaaatcccgaacccattctccacaagtcctgtgataacttcaatctcttccgcagcacataccggctttaccttaattccttcttctgcaaaaatctgctcctgcagagtacggaaaccgctggtcttggaaaacatgatctgtgggtatccggctgtctctttcagactgatccgttctctattttcaagcggatgtcccttcggaaccactactgcgatatatgaatcccgaatcggataatattcgatctcatccgatttcaaaagatccgagcaaaagccgatatcatattttccatccaaaagtccttctgcaatctccggtgtcatccgattgtagatgataaatggaaatgtcgccccaaactctttcagcatatgtggaatcgtccccggtgccagaggatacacactgccgatccgcaccgttttctcttccgtccgaagtcctgccgcccgctcttccagacgaagatacgctcccagaatttcatccacatccttcatcagctctttgccgtaatgactcaggctcacatttcgcccttctttttgaaacagcggaactccgtactcttcttccagcgacttgatcgcatgactgagtcccggctgtgaaatattcagtgcctttgccgcctttccgtaatgctggatttttgccagctctgaaaaatattttaaatattcgatattcatatattccctcttttatcttccgcagtcatcttatttttcaaaatcaactctttactcgccattatcttagcatatttcattctattttagaatcagttcattcaaaataatcatttgtttttatcagttttcttcattataatgagaaacagcttaaatataaaatttttgtaaattattatctatcaggaaagaaggatttgtacctatgaataagaaaaaatttcatctagccggagaagtcgctctgctcatcgtcctgctgatcaattcactcggcgtggatctgatgtcaaaaagcggattcgggatctcaacgatctcctcagtgccgcttgtatttaacatcgccttcccggtgttcagttttggaacatggaattatattttccagacactgcttgtcattacactgatgatcctcaagcgttcattctgccccggctaccttttctctttcgtagtcggaatcggatttggaaaaatgatcgacgtacacaacgcatggatccaggctctgccgaactccctgcctcttcacacgatttatttcctggcaggattcttactggtgtgcttcggtatctgccttgccaacaactgtatgcttccaatcatcccgacagatatcttccctcgcgatctgtccggtattgtaaaaaagaactataaaatcgttaagacaaccttcgatctcacctgtctgacgactactgtgattctttcccttgcaatcctccacggattctacggcatcggaatcggcactgtcttctgtgcattcctgactggaaaaaccgtttccgccatccagagttttcttggaaaacacgtggaattctaccgtgcaactgggaagaagagagttgctcttgaaaagaatatgagacatgcataaaagaaaaaagatttcaattttgatacataccagatcggatacatcaaaactgaaatctcttttggattctgtagccattcttattttctcaacttctcctgtcgcattgacaaacctttttcccatcccgtatactagaagcagactaatatcctgcaaggaggcttaactactatgattatcaaaaacggacttgtcatcgatcctgcttccggactttccgaaaaaatggatcttctgattgaagatggcatcatcaaagaaatggcatccctgattacaaaagaaggagaggaagtccttgacgcagccgggcttgtggttgcaccgggactgattgacacccacgttcatttccgtgatccgggatttacttataaagaaaccatccacaccggcgcacttgcctctgcaaaaggcggttttacttccgtgatctgcatggcaaatacttccccgactgtggactctgttccggttctcaaagacaacctttcgcgtgcttccaaagaaaagatccgtatcttccaggctgcttcgatttcctgcaacctgaaagggcaggaagaaaccgatatggacgccttaaaagaagcaggcgcatgtggatttaccgatgacgggatcccacttctaaacgcagaattctgcttccacgcaatggaaaaggcggcaaagcttaacgtaccggtcagccttcacgaagaagatccttctttcatccgcaacaacggaatcagccacggaaaggtatccgatgcgcttggcatctacggttctccttccattgcagaagaatctctggttgcaagagactgcatgctggcactgaaatccggcgccgatgttgtgatccagcatatcagctccggtatctctgtcgatctggttcgtacttataagaaaatgggtgcaaaacttcacgccgaagccacaccacatcattttacactgacggaagacgcagtccttgagcatggaacacttgcgaaaatgaatccgccgctccgtaccgaaaaggaccgtcaggcgattattcagggacttgcagatggaaccatcgacttgattgccaccgaccatgcaccgcacagcaaagaagaaaaagcaaaaccaatcaccgaagctccaagcggaatcatcggtctggagacttcccttgcccttggcatcacaagccttgtaagaccaggacatttatctcttattcagcttctggaaaaaatgaccatcaatccggcaaagctttaccaccttccatacggacagctcgccgaaggaaaggcagctgaccttgtaatcttcgatgaaaacgaatgttggactccaaccgagtatgcatccctttcatccaactcaccatttaccggaacgcctatgtatggcaaagtgaagtatacgatctgtggtgggaaaatcgtatatcatgattaaaaaaatccacggactttgaatcttctaaagtccgtggatttttccatcttcttatttttcttccagcataaagtatttcatacttgttccgctttccgccacatccgcaagattgatacaactgtttcccatacggtcgatcagatgcaggatattggtaaacggagcagtaaggcttgccttacattttcctttattgacacgctcaatatgcgctttccgcatcttgatatccagatccagaagcttatcctttcgcttcatcatcttgcctggttcgataccatcatctccctgcagtgccttcagagaatcacagaacatcttattcagtactttcaaactcttctgcagctcatccatcgcttccggtgtatatttatacttccggtctgatctttccaacatacattctgccatttccacacttaaggttcccatacgttccacatcgctgagtacacacatgaggctcgccgtctgcgctgcctgctgctcggtcaatgaccccgaagaaaacaaagctgcaagatattcggtaatacactttccaaggcgttcaacctgttctccgttttctttcagaccgtcaatagatttcacttcttcatttttcacaagctcaatcgttttcttcagaatatctcctacctggtcactcatacggaaaatctcttttgccacaagctgcagcgctgctgccggctgactgatgatattttcatccagataaatcgggctgcctggatcttcaacaccttttttgccatccgggatcagtgtcatgacaatcttcaccatcagtttaatcaggcatacccagatcagtgtcattgtgatgttaaatacagtatgtgcatttgcaatctgtctggaaatcgcttcaatctccggacctttcggcgaaatgttctggatcagtgccgcaaatggttttacaaaccagataaacaaaaagcagccggaaatattaaaaatacaatgcgccacagcggttctcttcgcatcttttgactgtccgatactggcaaggagtgctgtgatcgttgtaccgatattatcacctaaaagaatcgggattgctcctgcaagcccaagtatactcgtaaccccgtccggtcccggctgggaagcgaagttctgcaagactgcgatcgttgcactactactctgtacaaccagcgtcataaatgtaccaactgccacaccaagtaccggaatatgtgcaacccgtccgatcaagtctgtgaataccggactggatgccaatggtttcatgacatctcccattgtttcaattccaaggaacaaaagaccaaaggcaaaaatcgtctgaccgatactttttactttctctgattttgttacaaatgaaatcagaaatcctataaaaataatcacataaatataatcactgatcttaaacgcaataatctgtgctgtcatggttgtaccaatattggcaccaaaaatgatggaaattgcctgtggcaggttcatcagtcccgcacttacgaaaccgatcgccataactgtcgtcgcactgctgctctggagtaccgcggttgtaagcgcaccggcaagcacacccagaatcggattcttcgtcagaagtgcaagaatacttttcattttatcgcccgccgccttttgcagacattcactcatcatattcattccatagataaaaactgccagaccgccaagcagtccgaaaatgatctgaattttctcgttcatgttaattcctctctcaatttaccctgtgtttgttaatattttttaaacttactttttacaatgatgttttccctttcagctcattttccattttatctgtggtctatgcaattccaatcaaatctatgttaagtttaggttaaattttctttcttctatcattttttctttcccatgatcatagttatgtaaaatcgcattaaaaaagattgtgcctctccggcacgcagtgccttttgtttcataggaagtttcttcggaatttcctatgaaataaaaagagagttaccctcttacaaatcttcaaatttgcaaaagaataactctcctgttctatctataaatctatccaatccccagcacaccatatccaactattccaaacaccgccgcaagaatgatcaccttcggtactgaccagttcttcttcaatatcagatagaacatcaccactccgatcccgcacccaaaccagtcaatcctctcatccggaaaataattttcctgcatcagatccagaatcaccgcaaggatcattgcgatgcagattggcttgatcacatttaacatacagctcataatatcattgccacggaactttgcgaagcacaccgctacgccaagcgtcagcgtataagctggcatcagcacgcccataaccgctacaatcccacccagaacacctgccgtctgcatcccggcaaaagtcgcacagttaatcccaagcggtcccggtgtcatttctgcgatagcgatcaagttagtcagatcctccgccgtcatccactgattgaccttcatctcctgcataataaccgggatcatcgacattccgccaaagctggtaaatccgattttcataaacgctgtaaaaagtctgagatagatcatgccgtctgtcctcctcttgtctttttcaccgctcttatagaaagcgccagtatcactcccgctacgatcatcaccacattactgatatccgtaaatacacagagcgccagtgctaacgcacagatcgggattgctgattttctgcggaacgcttctttccccagtgaaagtgccgcacttcccataatcggaactaccgcacagcggattccgcgaagtgccgcatagcaccagacattacttttcagcaccttataaaatgcagtaacaaacgacaggatcagaaccgccggacaggtcattccgagtactgcacagacacctccgaaccagccacctacataataaccaaacagcatactgatattggtgatcataattccgggaactgactttccaactgcaaccatatccagcagttcctcttttgtgatcagctttcgtttatctacaaactcctgctccatctgcgccagaatgctccatccgcctccaaatgtaaaacatcctatcttaaagaaaaatgcaaacagcatcagtccatttttgattctctctttactcatctcttcttcctcctgtttctttactttatcatctctattgacattagtaaaatatatgttttattattaaaaatatagtttaaacctatggaggattttttatgaactggaatcagctgcagtatgtcatcaccattgccgaagaaaaaagtatcaccaaagcggcgcagaagctttatatttcccagccttccctttccttaagcattcaggctctggaaaaagaaaccggaatccctctttttgaacggaaccgtggcgagatgaagcttacctatgcaggctcccttttctatgaatgggcaatttctaccctccactctcatacccagttggaatggaagcttggtgatatcgtttccggctcccggacactaatccggctgggtctcagtccccaccgaagtgaacggcttctggcaccggttctggaacgcttttattccatgtatgagaactgtgatatccagatcattgagcaaccgacctatatcctgcggcagatgctggaagaggacaagctggatctgattctcgatatttccagcccggacactatcaattatgagagtgagcttctggtaaaggaaagttttgtcctggcaatccctgactctctgtgtcctttttccgatccatcacaaaaagaggaggacatctctgccactcctcaaattcatttgcctgcgttatctgcaattccatttattctgctttctgaagatcacgatctcggaaagatcagccggaagatctgcgaaactgctgccttccatccgaatatccgctgcatctgcaccagcagtaatactgccttttctcttgcaagacgaggaatggggattgcctttcttcctgaaatttatgcacggactacttcctttccggacattcatttctttaccccggatcactttcatgacaccagggacatctgtgctgtctatcggaaaaatatttatcatcacgcacagtttcaggtgcttcttgctctccttcgcgagatcgttccggcaatctacagggcagcttagtctgccctgatccgtaccttaattctcttattttctgcctcttactctacatttttcagtgcctcatccatcggcacatgtttaatccttcgatattctatcattgccacaactgcataggttccgatcccgatcagaaacatttccacatagatcttcggatcgatccaaagtgcgatccagccggaaatactggtcaacatcatttcccggaacagcacattcataactgctttctcaatcggcaggctgagaaacagacagatgatcaccacgatcgtcgtcggccagatataaagcctgctgatctctccattggtatatcccaggatcttcgtcatggaaatagcctgtgcatttttctcaataatgatcttggataacagatagatcacgaccatgtaaattccaattgcaaaggcattgaccatccccatcatatttcccatagatacatccagctgtctcgaaatctttgtcagtgcttccagatcaagcaccgaaccgatgtatttcccgtcaatatccttaatcttcgaattggaaaaatatccactgaaataatcgtttcccagatcaaaggtatcatttaacggctcctgtggcataaagacacagattccaccgctgtatttgtagattcctttaaccttgaatgtatactttgtcttttcatatttttctttcaacgtgatcgagtctcccagcttcaacaaaaacttctctgcataggcactggaaatatagacaccgtcaccgtcctccagatctgcatcgatatatttactgtccggtttgattccgtacaggatcacttcatctgtcttatatttgcttggcaatgtttccaatgagtaagcactgaacgcttccgcatcttcattttccgtctttgttccataagagaactgcaaaagttccagcatactgtccagtttgtttccgctcatcgcacttaccggaacctccagcatatactggtattttgcaagcatattgctctggatttcctgctgataatgattcagtacagaaggcagtaaaagtccaaagaataaaagcaggtttgcaaatacaattccgataaaaagcacgatataattgctcatattctggaagatcacacgcagtcggaaccgatggaagattccaagcttcggacttagccggactgctcttttccgcctgcttccagaaagatctcttctcagaaatttcagcggtgaaagcctcagcttgtaacgaaggattccatagttgaccaccagcatgatcagcaccggaactaccgttgtcatccagaaagcatctgcattccatgctgtcacataggtcggcagactataacttccataatacatccccgcacatacctttttcagtgctgtataacccagaatatttccgatcaccgcaccgatcagtgtgacgatcaccggaagtgccatgtaatgtccgatcagttcttttcttgtataaccggaagcccgcagagttccgatcacgcctgcttctttccggatcgtattgctgatcgtgattccaaatacaaacgccataatcacaatgatcatatagaggagcattatgatcattgcacggtcactccccatatcatcaccggtaaatgtaattgcctggttcagatactgtggcacaaaagactccagagtgacttcttcccccagtgcttccatcagatcttccgacatctttttttcctgtttttcatttttcggttctttgtcatacacccaggaataactgtactgaatcttatcctgattcagagattcaaactcttccggtgttacaaccgataccccgaatttgattgcatcaaacatactgtcattattgttctggaacaggcagctatagtcagacagtgccacaaatcctgtgactttccacttttgtgaaccacttttcagtgtatctccgacagaaatcttattattgtccgcatacatacggtcaattgccatttctcctgctttttcaggaagctttccttccatcaggcacaccaggttgatctcttccctgtttttgaaaatacgcatggtacttccattatccagtgcctcttccagataaaagttttcatacagtgtcacgccatttttctcgatatttccctgttgtgctttggtaatttttttctttacccggaaatttccatcttcaatcttgtatttctcaaagccttcattatatgcttttatcatgcttccgtcagcaaccagaaagccggatacaaacccaatcgttgcaatcataaggatcagaaccaccaggtattttccaatttctcccttcagttctctcggaagccgttttctcaacggactcttcataacacgcgtcctccttaccattccagctcacttgcagaaagtttatgctcattacagtaatttttgcggatcattccatcacgaagttttaccacccggtctgccatatccttgattgcatcgttatgggtaaccataataatggtattcccatatttctgattgactgtttcgatcagcttcaggatttccttggatgtcttataatccagcgcaccggttggctcatcacagagcaggatgtccggatttttgacaattgcacgtccaatcgcggttctctgctgctgtcctccggaaagctggttcggcagcttgttctgatgttcataaatacccagcgtttgcatcagctcatccacatccagcggacgattacttaaataagcaccgatttcaatattttctctaagtgtcaggtttggaatcaaattgtacatctggaatatataacccagatgctttctccgatacagggacagcttcttctctgtcatatcctccagctgttctccgtcaatcgtaatacttccttcatctgccccatcaatgccgcctataatattcagaagagttgattttccggaaccggatggtcccagaagcacacaaaattctcctctttcaatttccagatcaagtcctttcagaacatttacccggctgtcgcctgttccaaacgattttttgatccccttaatctctaaaaacattcctctactccttcctttagttactcgcatcgtagtaatgttatgtttcatacactcatgttagattagacttacttttttgtcaatattttaatttttattttttcaaaaagatattgacaaatgggaggaaaatttttaaaataactatctgtgtaattttataccaaaatctttgtggatttttctggatatcaaaatagatgtctacttttcgccacataacttgttgcagacagcggcagttatgtggctttttatgtatcgggcttctgcccttttttacagattttgtaccttatgctttatatttatcaggaggaatgtttatgaaccagacttacatgaaagaaaaaccgattctgccgcttctgctttccatggctctgccaatggtgatctcaatgatggtcaactctctttataatattgttgacagctatttcgttgcacggatcagtgaagaagcaatgactgctctgtccttagtctacccgatccaaaattttatcacctcagtcggtgtcggctttggaatcgggatcaatgctgccattgcctttttccttggcgcccaggatcagaaaaaagcggatacagctgccacacagggactttttctctctgtcatccacggtattgttcttaccgtagtcacaattgccgtaatgccgctgtttttacagatttttacaaaagacgtgaccgttattcagatgggaaatgcctactcccggatcgcatttggattttccattgtaatctctcttgaaattacctgggaaaaaatttttcaggcagtcggacggatgcgcgtgtccatgatctgcatgatgagcggatgtattttcaatatcgtactggatccacttctgatcttcggaatcggaccgttcccgaaaatgggaattgaaggagccgcacttgcaaccggtcttggtcaggttgtcacactggtactgtaccttgccttttattttaccagaccgcttccggtgaagattcataaaagctgccacgtagatcgtgccatggccggacggctttacgcggttggaatccctgccactttgaatatggcacttccatccctgcttatcaccgcactgaatgggattctctccgcctactcccaggtttacgtggtggtgctcggaatctattacaagcttcagaccttcctgtatcttccggcaaatggaatcatccagggaatgcgtccgctgatcggatacaactacggtgccggtgagacaaagcgtgtccacagactgtttgccgataccctttatctgagtcttgggatcatgctctttggtaccgttttctgccagctcttcccggattcactgattgcactgttcagttctaatccggaaaccattcatgcaggaggaatggcacttcggattatcagcctcggatttttagtttcttccgtgtccatcaccagctctggtgcactcgaaggacttggaaagggaacaccgtccctgatcatctcactgtgcagatatacgatcatcattattccgaccgcatttatcttaagccggatcttcggggcttccgggatctggtacgcattcggaattaccgaatttgcaactgctgtgatcgcctatatgacttacctgcgggcaaccataaaaaactagacatatctgcatcaaaaaattctactactttttcgatacaacaaaaaaccgcaaatccggatttgctctttacaatactgcaaatctccggatttacggtttttaattttctctttattttacttttccatcccagtccgactttttatttgcagactattcttcttcgctgataatatgtctcgcaacataaacaccacttgcagatgcatgggacagagaatgtgtaacaccacttccgtcaccgatcacatacagtcccttatggcagctttccagattcttatcgatctctacttccatattgtagaattttacttccacaccatagagaagggtatcgtcatttgctgtaccaggtgctaccttatccagagcatagatcatctcaatgattccatccatgattcgctttggaagaaccagactcagatcaccaggcgttgctgataaggttggtgttaccagaccttcttcaatacgcttttctgtacttcttcttccacgtaccagatcaccaaaacgctgtacgatcacaccaccgcctagcatattggaaagtcttgcgatactttcaccatatccgttactgtccttaaatggctcagagaaatgctttgcaaccagaagggcaaagttggtgttgtccgtctttttttcatttccttcatagctgtgtccgtttactgtgatgataccattggtattttcatttactacaataccgttcggattcatacagaaagtacgcacattgtcctcgaatttttctgtacggtatacgatcttgctctcgtaaagctcatctgtcaggtgtgagaagatcactgccggaagctctacacggacaccaatatccacacggtttgatttggtcgggattgcaagatccttgcagaccttttccatccatttgcttccgcttcgtccgacagaaaccacacatttcttacattcataagcgccattttcacatacaatgcggtatccgccatcagtgatctcgattgtctcaaccggtgcatcaaagaagaagtccattttatccttcatttgatcataaagattctgaagaacgacgtaattgatatctgttcccagatgacgtacagatgcatccagaagattcagcttgttctgaagacaaagctttttaaattttgttccggctgtggagtacagttttgtcccttctccaccattttccatattgatctcatcgacgtacttcatcagctcaacagcctgttttttaccgatatactcaaataaagttccgccgaaatcattggtgatattgtattttccatctgaaaatgctccggctccgccaaatccgcacatgatcgagcagcgtttgcagttgatacagctctttactttttcgccatcaatcggacattttctcttttccagcggataaccttcttcaaatactgcgatcttgcagtctggtttctttttcatcaactcataagcagcaaaaattccgcctggtccggcaccgataataattacatcatacttcatccgtatatctctccttttatttgcatgataaaatataattttcactaaattgcctgtgtcataaatatagactgtaatatatgtacaattctatactatgtcacataataaaactgccgcatatctgtctgtatccagatgattctgcacggcagttgttcttcttttgcacaacctttcatattttaagagaaatctttcttttcgtcaaggtgtttctttcttttttgtatgaattttgcatgaatttattttgttttttatatagattttgttatatttttcattatccagtttttatatttgcactgtcaaaaatctttctgtttctatattgctgtttctgctacccttttcattttctgacggatttacagcttcacgatggtcggctcatgttccattgccggaataatcttctccaccagatcttttgtccgaagtctgagactcgatgtattgatgcatggatgacatcctatatattctcctgtaagcacatcttcatcgatcagaagccgtaccatcctgtccttatcattcatcagtccaagcacacttaaagatcccggcgtgatgtccagatattgttccatatactccgcttttgcaaaagaaagtctggacgaaccgatctgtgctgacagctcctttgttttaaacaccttatcccccggaagcatcagtaaataaaattgtgtctcctgtcggttgcataaaagcagattcttacagattgtcgcctccagcatccggtcaatttcctcgcatgcttccattgtcattgcggcttcatggtcgattctctggtaggtgactcctagcgaatccaggaaatcatatacgcggatttccttatccaatctgccttgtgtgtctgttggttttccgtttactaattccatgtagttctcctccgtcctagactttattctttttaaacatttcattctctgcatacttgtatagcaaatgttcatcgcggtgtaaaatttttccaaacagctctatctctccatcagagtatccttctccccaacaagctaattatatcataagtccttttatatcaaatatttttctatcagattctctattatctttgaattcaatacattttgttctgtctcaaaagttataatcaaccgatcgccaggatatatatgatttatttgatacaattctatttttcgcacagctgctcttgcataatcctgtttatccatcattccctcatgttcccagtatatttcttgataagtcttttttgataaaaatgtaaaatctggatacactgtaccgtatcctttcagatgaagtggtttttcatatttgtaaaggatgttttttctataaaaataatctgctaatatcttctctgactttgatctgacacgttctcccttctcagtaagaattaatggtgttccctccttaaactctttcccctgatattcttcttcataccattttgtaagcagctgatcccatgttggttcgatcggagttaccagtaattgtctcgctttattcatagatgtataaattttttcaatttcatcatccgaataattttttgttattctctttatttgtttaagccttgcttctcccttttttaccactgccttattataacctttttgcgccaggcgctttggcaattctttattatctcttggaatgtagactcctttgttatcatctatacattgataatagcgcggcttatttttatctattgaaattctgaggtgtccttctggtactgttgtattcaaatcagctttagcttgcgtaacaactttctccaaatgttcctgcatctgaagaagcatgttttctaattcatacatatatatatacatttctcctttgcttttctatttttcaaatcctaatcaattcatttcgagaattttcttgatttgtttcgaattttgaaaattataatcaactcattcctataatcttcttgatttatttcgagttttgtcaattacaatcaactcatttctgtaatctttttgattttctttgagttttttagaatacaatcaatttatttacatcatcttcttgatttattttcatttttccggtatgcaatcaatctatttctgaaattatcttgatttattttcattttttttggaattataatcaacctatttaattagactgtcttgatttgttttagcttgtaataatttgcaatcaatttactctttgcaaaaatgatttgataaaagattttttgatttggtggattcagtgtatcatatatattctgaaaagaacagtaaaattttcattttaatcataatttaatatttctaatctataactagataaaataagagagcgtgtgaaaaaacgaaaggttttttcacacgccctcttattatttatttcttgctatacgcaatatgcttattttgcattcttctgagcgattgcagcctgagcagcagccagacgagcgatcggtacacggaatggtgagcaagatacataatcaagaccaatgctgttgcagaattctacagagcttggatctccaccatgttctccacagataccaacgtgaagtttcggattaaccggttttccgagttcgatagccatcttcataagtttaccaacacctgtctggtcaagtttagcaaatggatcgttctcgaagatcttagcgtcatagtaagcttcaaggaacttaccagcatcatcacgtgagaatccgtatgtcatctgtgtaaggtcgtttgtaccgaagcagaagaagtcagcttcttttgcgatgtcatcagctgtaagagcagctctaggaatttcgatcattgtaccaacttcgtactcaaggtcgcttcctgcagcagcgatttcagcgtcagctgtttctactacaaacttcttaacatatttaagctctttgatatcgccaaccagcgggatcatgatttccggtttaacattccaatccggatgagctttcttaacattgatagcagcacggataactgcgcttgtctgcatcttagcgatttccggataagttacagcaagacggcatccacgatgtcccatcattgggttgaattcgtgcagagagctgatgattgctttgatctggtcaacagatttgccctgtgcatcagcaagtttcttgatatcttcttcttctgttggaacgaattcatgaagcggtggatcaaggaaacgaatagtaaccggatttccttccagtgcttcataaagtttttcgaagtctccctgctgttccggaaggatcttagcaagtgcagcttctctttcttctactgtttcagagcagatcatttcacggaatgcatcaattctgttgccttcgaagaacatatgctctgtacggcaaagtccgataccttcagcaccaagttcgcgagctttcttagcatcagctggtgtatcagcatttgtacgaactttcatagttctgtacttgtcagcccatcccatgattcttccgaattcacctgcgattgtagcgtctacagtcgggatgattccgtcataaatgttacctgtagatccatcaagagagattgcatctccttcatggtattcttttccaccaagtgtgaatttcttgttttcttcatccatgttgatgtcaccacaaccagatacacagcatgttcccataccacgtgcaacaacggctgcgtgtgatgtcataccaccacgaactgtcaggataccctgagcagacttcatacctgtgatatcttccggtgatgtttcaagacgtacaagaacaactttttctcctcttgcagcccattctacagcatcatcagctgtgaagacgatcttaccacaagcagctcctggagatgctccaagtgctttagccatcggtacagcagctttcagtgcagctgcatcgaactgtggatgaagcagtgtatcaaggttacgaggatcgatcatagcaactgcttcttcttcggttctcattccttcatcaacgagatcgcaagcaatcttaagagcagcctgagctgttctcttaccattacgtgtctgaagcatgtacagtttaccatgttctacagtaaactccatatcctgcatatctctgtaatgtgtttccagagtcttgcatacttctttgaactgcttgaatgcttctgggaatttctgttccatttctgaaatgtgcattggtgtacgaacacctgcaactacgtcttctccctgagcatttgtaaggaattctccgaacagtccgttatttcctgtagctgggtcacgtgtaaatgcaacacctgtaccacagtcatcacccatgttaccaaatgccatcatctgtacgttaacagcagttccccatgaatacgggatatcgttgtcacgacggtatacatttgctctcgggttgtcccatgaacggaatacggctttgatagctcccattaactgttcctttggatctgtcgggaattcagcaccgattttttctttatattctgccttgaactggttagctaattcgtgaagatcttctgctgtaagttcaacgtcctgtttaacgcctctttcagctttcatcttgtcgatcagttcttcgaagtattttttacctacttccataactacgtcagagtacatctgaataaatcttctgtagcagtcccaagcccaacgtgggttgcctgatttttcagcaagtacattgacaacgtcttcgttaagaccaaggttcaggattgtatccatcataccaggcatagatgctcttgcaccagaacgaacggaaacaagaagtggattctctttatcaccgaatttctttcctgtgattccttccatctttgtaatagcttccatgatctgagccatgatttcttcattgatctgtcttccgtcctcataatactgagtacaagcttctgttgtgattgtgaagccctgtggcactggaagacctaagtttgtcatttcagcaaggttagcgccttttccaccaagcaggtttctcatatcggcattaccttctgtaaacatgtaaacccattttgttgccattttacaattcctcctcgttattggtaattgatatatataaaacttgaaaatcacagtcagactggtaactgtctgctcttttcatatcttatatcgcccttaaaaaacggattttaccgcactaatattgtaaatgttttaactgtgatagtcaacccttatgcactttttttcgtacaaaaaaagtgaatttatcgaagagttcaattccttcaagtgatttcttctataaaaaaaatctccgtaattaaatttcttttatatactataaattttgttattatcagaaaaaactcaggcaaaaccggactgtatccattgttttgcctgagttcttttcatctcttacatattcagaaggaatgctctgtatccctttactgcttcatacacatcagctttgctgctgacttcataaggtgcatgcatggaaagtacagcaacaccgctgtcgatcacttccataccataatttgccataatatatgcgatggttccgccgccgcctacatcgactttaccaagttctgcgaactggtaagtaacgcctgcatcgtccatcaccttgcgcagtcttgcaagatattctgcatttgcatcattggatccgctctttccgcggcttcctgtaaacttgttgaatgcaagtccctttgtaaagaaagcggcacttctcttttcaaatgcttctgcaaacatcggatcataagcagcgcttacgtcagaagaaagcattcttgaattagcaagtgcacggcgtaccttcagttcagattcaccttctgtaagtgcaacaagctctgcaactgtattttcaaagaaacgagaatgcattcctgttgctccgacgcttccgatctcttctttatctactaacagacagcatcctgtacgctttgcattttccacatccagcatagcgaacagagaagtaaatgcgcagactctgtcatcctgtccataagaaaggatcatgctgcggtcaaatccacaatctcttgcctttccggccggaacaatttccagctcagccgatgcaaaatcctcttcttcgattccatagttctcttttaaaatatgaagtacgttagccttgatcgtttctttttcttcttcatcaagtccctccgctttatcaagtggactgtttccaatcagaagatccagcttttctccttcgatcacttcacttgctttctttgacatctggtttgctgcaagatgaacaagaaggtctgtaataacaaataccggatcagactctttttccccaatgctgatctcttctacgcttccatcttttttcgcaacaacaccatgaagtgccatcggtcctgttacccactggtattttttgattccaccataataatgtgtatccagataagccattccttcactttcatataatggattctgtttcacatcaatacgtggtgaatcgatatgagctccaaggatattcataccgtttgaaagcggttcttcgcccatacggaacatggcaagcatttttcccatgcataccgcatatactttatctcctgctttcaggctctttccttctttcagaacatctttgatatcctgatatcctgcttctttcgccatctcaaccgcaagctttacgcattcacgctctgtctttccggcatccaggcaagctttgtacttttcattgatttcatgaagttcttttttggcagcttcatcataagagctccagagattctttttttcttccatttctatacctctcttcaattcagttgggattccccacaatgctttcagtataaccctctcccgataagaagtcaattattaccctttaactttacaagcatttccgtcatcgtttccttcaaaaccggatgccgtttatgcggtgcgatctcacacattggtccaagcacaaattccctgttctgcatatcgatatgtggtatacataaatcatcctcttcaatgatctgatccccatagaaaatgatgtccagatccagtgttctcggtccccatctgcggatccgctttcttccggcttcctgctcaattcggtgtaacagctccagaagctcatgcggggtaagcagtgtttccattttcagtgccccgttcaggaattcatcctgatccgtcacgccatatggctcggttccgatcagtttcgataccttcaggactctgcaaagtttttcatttttcagctcttctaccgcattctcaatgtattttttcttatcacccatattcgatccgagtgcgataaacgcttcattccagcaacgttcaatcttcacagaaaccgtctcaagcggcagtcctaccggtgcccatggtttctttacttccaccatgactttccggatcttctcatcaaataataagatctcttctgcaagctgctctgctactgcttcgatcagcctgtaattcttctcttccatcttttcttttatcagatgggaaatggttccgtaattcacagacgcttccaagtcatccgtttttcccgccttgcgtgtatccacatataaaatgcaggaaaccagaaacttctgtcccagtctgttttcttccggatacaccccatgatttgcaaatatttccaggttttcaatttttatctgatccatctttttctcctgcttactctcttgccagaatcacttctgtcatcttgatcgctctgcggtttttctcagcatcatgaacgcgcacaaatccataatgactctgtactgccatcacggttgtgacaagagttccttcttctctttctgttaccggcagatccagtgtcagaccgatcatggattttctggaagttccaagaagcatcggatatccaagtccgttaaaaagatccagatgcttcatcacatccaggttcatctcgtaggtctttccaaatccaacccccggatccagcatgatccggtcatcttcaatcccagccgctttcgctgtatctacacacttctgcaattctgcatacatatccttcaggaaatccttgtacaccgcctcatttttattatgcatcagacagcatgccgcatcatattttttcacaagacctgccatcttttcatcgtactggaatccccagatatcatttaccagatctgcccctgcctgaagtgctgcctctgccacatcactcttataagtatcaatcgaaaccggcacatcaaaattctttttgacagcctcgataaccggcgcagttcttgtaatttcttcttctgacgtaatctgctggtgtcctggtcttgtggactctcctccgatatccaggatatcggttccgccttctaaaagctcttctgcatgacgcattgccgcatcataaccgttccactttcccccgtccgaaaaagaatccggtgtcacattcaggattcccataatataagtatggtttgctgtgtcaaattctttattcccaattttcattttgtttcctcgttttctaccagatgattttctgattcttcttttctccgttccagttacagtccttctcagccggacacgtataacacgcacgggaaatcttatctgcatcataaaggatttctgcaagctgccacttatcctgccctgcattttctgtctcttctgcattgccccggtgacttaaaattgcaaaaagaatcctgtccgactcctcctttgtaaatccagtctcttccagaatcctttttgcaatttcagcactcgctatctcatggggaactcccgccttatactgctgccatttcccgatatcatgaagtaatgccgtcgcataaatctcttcttttccaaaggcatatccacgctccatcgaaaaaatatacatcagacgtgccacgtccagaaaatggttcatatcatgatggcagaatattctttccttttctgcatctttattctttaccagtccttctataaaaagaggatgctcatatattttccagattctctgcatcctcctctgctcttccagttttcgttttatttccatcgcactaacctatcatacggaaaaacatgttctgcagcttttcattttcttcaaatgcacctcttgtaacaacactgaccgtcttgcttcctggcttcttgattccacgcatggtcatacacatatgctctgcctcagcaagtaccattactccctttggatgaaggttctccatcagggcatccgcaatctgtgctgtcatctgctcctgcagctgaagtcttctggcaaacacttccacagtccgtgcaagcttgctaagtcccactacctttccatccggaatataggcaatatgaacctttccgtaaaatggcagcatatgatgttcacacatggaataaaacgtaatatctttttccacaaccatctcattgttttctgctgtaaatgtctttttcaggtgttccgctgcatcctcattcattccgccacagatttcttcatacattcttgcaatccgatccggtgtctcagcaagtccttccctatccggatcttcaccgattccttccagtaaaagacggattgcctgttctacttttttatgatctaccataatgttctctcttccttttttctttcaaacacgtttgtttcccgttcaagtcttatcacttctcccagataagataaggaaccaaacaccagaacaacatcttctttcccacattctgcttttgctttttcaagcgcatctgcaatgttctctgtcggttctgactgtacgttcttggcctttaatacttcacataatctctcttttcccagattcctctccccatttggaagatcgatcgtatacacctttgaaagatacggagccatgatctctgcgatttgttcatattctttatctttaaaaacccccatcacaccgacaatctttctgtccgtcagataggttctcacattttccgcaagtcttcttgcggcatccctgttatgcgctccgtcggcgatcacggtcggttctttttcaagtacctgaaaccgtccaggccatgtcactttcacaaatccctttcttacagcgtcttccggaatcggaacaccgctccttcttaacgcatccacagcttccaatactgtcgccgcattgtcaatctgatatctgccagccaggcgaagacggatatctttatattccccataagaaaaaatctgtccatccatcgtttcttcagaaatcacagccttttccggatgcgaaaccacaaaccggcatccacactctccggcctttttctggaggatatcggtcacagacatctgctgtggcgacgtgacaactgccagacatgatggttttataattccggctttattttctgctatctcttctaatgtgtttcccaacactccgatatgatccatactgatcgatgcaaaaatactcaaaacagttgtatctattacatttgtcgcatcaagaagcccacccatcccggcttccagaacgacataatcacactgtttttctctgaaatagagaaatgcgatcgctgtttctatctcgaaaacagttacggtgagatccgttttttcttctactttttctgctgcctctttcacctgagatacaaaaggggcgagctcgtcctccgccatccattggccatcaacctgaaatcgttccatatatcccatcacggtcggagaacagtattttccggtccggtatccagcctgctgcaggataccggagagtccggcgagaatcgatccttttccattagtcccggctatatgtataaatttcaaatctttctgcggatttccaagctcacccaataagctctttatactatctaagccaagtacacttccgtatttcgatacatgatccaaatatacccttgcttcttcgtataacatgatttaattttcctttttgtacttttcagcatatgctgatatctgaatattttatcatattcccttactgctgtacagttctatttctttttctttggtacaacgtggatcgctccaccctctgcttcttccagggcttctccgattccttcattatacgtcggatgtgcacgcattcccttcaaaagctgtgcaaccgtcattttgtttgcgatcgcagttacaaattcaccaaccatgtctgtggctcttgcacacatcatctgtgctccgagaatcacatctgtctcttcatctgccacaatcttgataaatcctctttcttcttttgtaataagcgatttaccattggcactcatgataaatttaccagtcttcactttgattccctgttctttggctgcatcttcggtaatacctgctgatgcgatttccggatctgtataaacacatcccggaaccacatccagattcacagaaggttcttttcccgccagctgttctgcaacaacgattccctgtgcacttgctgcatgggcaagctgtgcaccaaagatcagatcaccgatcgcatagactcccggaatactgctttcgaatttgtcatttacaagaacgcgtcctctttccatatccggagcagcaccttctgcaaataatccgtcggtattcgggcatcttccgactgcacacagaacatattctgcttctacagtctgttctttttctttttcagcgaaggtacatacacaagtatccccttccatatgcacaccctgtactgctgctgatgtatggctttctacgccacgtttcttcaggatcagtttcaggttttgtgcgatctctttatccatatttggaaccaggcgcggcattgcttcaagaatggtaaccttagatccaagtgcggaatatacggttgcaaattctacactgatcacaccaccaccgatgataaccagactctttggaacttcactcagcttaaaaagttcatcacttgtcagaactctcggaagatccattccccggattggaagaatcagtggtttggaaccagaagccagaatgacattctctgcttcgacaaactgttcttcatttcctgtaatcttaacttttttcccctcaaaaagtgtgcctttcccataatatcttgttacgccgtttgcctgcagaagctgttctactccctgaacaagctgtccggttgtctgctccttatattccagtattttttcaaaatcataagtaacatctgatgctgaaattccgaaacgatccgcttctttgatttcacgatataatgtcgatgcatgaatcattgcttttgccggaatacatcccctgttcaggcacgttccgccgacttctctctcttcgatcactgcggtcttcattccaagcttcgcagatttgattgctgccacatatcctcccggaccggctccaattactactacatcaaacttctcactcattttatttcatcctcctacagttcctcgccccgaatccattcgataatgtctttcatcatcccttcttcctgtggatcatctgaccagaaaagccccaattccgtacagatactttcctttctgtacttcaatcctttcagatacttcggaagtgtatgtatgaaatccggattcagtgcatccgaccatgcaattgcatccttgatctttcctgattctactgcaaactgaagtgtaatccctccccatccaaaacggtgggaaagctcatactgaaaatcaatttttcttccataaagccagttccatgaagagaaaaatttctctctttctgcaattactccggtatcaagatcttctatttttttatcacgtacctttaatccgtataccttttcaaatgactgtttaagtgccaccttcagttcttccattgtaagctccggaagataatctcttaaatttgtcactctggattttactgaatcaaccccctttgatttcagtttatcctttgatacagtcagatatctggataaggtttccatatttactcctaccatgatcgtgccatgatgatagcaatgcttttcctgctcataaaacgcatttcccgagaatttctttccatcgatcaggatatcgttacgcccggatttttcagccttcaatccaaggatctccatcgctcctatgattacctgaagctgccggtccagatcatattcttctttattgatcagaaatgtgaagttcatatttcccagatcatggtacacagctccgccacctgacaggcgtctggcaagatgaccaccttcttcttcaagctttgttgttctacattctttccaagcattttgattccgtccgataacaactgtattctgattctgccacagataaagaatacattctttatcctcgcagtggaggagcaaatactcctccactgcaagatttctatatggactgaactgattgctttcaatataagtaatcttttcaatcatagtttttccctcgctttaagctataacttattagtcctgccattcgtatcgcagatatggatgtcttgctgctccaacctcatccattcttgtaaccggtgttgtaacaggagcctgatgaagctgttcggcatctgtttctgcgatttcatacagtttgcgtaatacttctactgcttcatccagagtttctttggactctgtctctgtcggctctaccatcagtgcttcctcaacgatcagcgggaagtacattgtcggtggatggataccgttatcaagaagtccttttgcaatatccattgcagaaattcctgttttctttttcaaatctgcaagactcattacgaattcatgcatacatacctcgtcatacgccattgtataaaggtctttcagtttgttcatcatgtaatttgcattcagaactgcattctggctcgcttccggaataccttcgcgtcccagtgtcttcacataagtaagtgcttttacgatgactgtaaagtttccatagaagctcttcatctcaccgatgctctgtggttcttttacaaatttcagttcttcttccccatctactacataagatggaaggaacggaaccagcatgctcttgcatccaacaggtccgcttccaggaccaccgccaccgtgcggagttgagaatgttttgtgaagattcagatggatcacatcaaatcccatatctccagggcgaacagttcccataactgcatttaagtttgctccgtcatagtagcaaagcccgccacagttatgaataatctccgtgatcttcagaatattcttatcaaaaagtcctaccgtatttggattggtaagcataagtcctgctgtatcctctccgcatacttcctgtaatttttcaagatcaacaccaccatccggtgcagattcaatgctgactacctggaatcctgccattgccgcacttgccgggttggttccatgtgcagaatccggaacgataattttctttctcttttcgtctccacggctcttatgatatgctttgatcagaagaagtcctgtaaattctccatgagcaccggctgccggctggaatgtcatacgatccatacctgtgatctcgcagagaagattttcagattctttgatgacttccaggcatccctgtaccgtatgtgtcggctgcagtggatggatctctgtgaatcccggaagtgatgccatatcttcattgatcttcggattgtatttcattgtacaagatccgagtggataaaaaccatcattcacaccatgtgatttctttgcaagttctgtataatgtctgctcagttcaatttcagaaagctctggcagatgaagttttttctctcttttatctttttcctgtggaagtgttacttctacatcgcattctggcagtaaatcgcaacctcttccaggtctgcttttttcaaatattaacattactgcacctccttcagaatctgaacaactgcgtccatctcttctttggtattcacttctgtacagcaccacagaattctgtgttcgtcaagcggaaatcctccaaggattcctttttcctcaagtgctgcaagtgcttttgcggtcggaacatcggatacagttacgaattcatggaaaaattctcctttgttctcggtctgatatccaacttttgcaagttctgctgaaagataatgtgcttttgaagttgaaagtattgctgctttcttaatcccttcattgcccattgttgccagataaacgcctactgctagtgcgcagagtgcctggtttgagcagatattgctggatgctttttcacgacggatatgctgttctcttgcctgaagagtaagtacataacctttctttccattgtgatcttctgtctgtccaacgatacgtcccggaagatttctcatcatcttctgtgttgcagccataaatccaagatatggtccgccgaatgcaatagaaagtccaagtggctgtccttcgccaactgccacatcagctccatattctgccggtgtctttactacaccgagagaaatcggattgacattcatcacatatttcgcaccagctccatgtgtgatctcaccaatctcggctgcttcttccagattaccgtaatagttcggatgttggatcagtacacatgctgtctgtgcatctacatgttctttcagatattccatatctgtaagtccgtctttttccggaattacttctatttccatttcattaccgaagcagtatgttttgattgtttcaagaacatatggattcacggtagctgaaacaagtgctttgctgcgttttctgtcacggcacattgccacaccttctgcggatgcttctgcaccatcatatacgcaggcattggaaatatccattcctgtcagatcacagatcatggtctgatattcaaagatcgactgcaggattccctggctgatctctgcctgataaggagtatatgcagttaataaattttcttttgaaatcacgctctttactgttgccggaataaaatgccggtaagcgcctgcgccgcggaaaatcgtcttaaagacctgattctttgcagcaatattttccatatcacgacgtacttctaattctgtttttccttccggaatattaagaccgccctggatctttacttctgccggaatgtgtgcgaacagatcatcaattgtctgaaacccgatttctttcagcatttcctgacgctgttcttttgtattcggtacatagcttcccataaatggtccaccgcctttccctgattattcttcgcttgctgcaaatgcctcatattcttctgctgaaagaagttcctctgttcccgatacatcttttactttgatgaaccatgcatcatacggagcgccattgatcttttctggtgcgtcaagaagttcttcgttgatttcttcaacttctcctgttaccggtgagtatacatctgataccgcttttacagattcaacatctccaaatacttctccggcttctacactgtctccagcttccggaagatttacgaatacgagatcaccgagtgctgactgtgcataatccgtaagtccaattgtccagactccaccttcttcttttacccattcgtgtgattttgtatattttaattctgctcttacttccatgattttaatctccttttcttttcaactgccggtcgccttttccaaacactctctatcgcttttttctgcgaccggactgttaatctattttcgttattattttcttttattttgctctcttatagaacggaagctgcacaacttctgcttccactcttcttccacgtacatctgcttctaccttgtcgccaattgctacgcttccggcatcaacaagtgccatggcgattggatatccaagataagggcaatgcgttccggatgttgtatgcccgatcttctgatctccagcatacagatcctgatgttcacgaatgattcctcttcctgttactttaagaccaattctttcgatctttggtgttcctctgtcttctatggctttctttccgatgaattcgtctttcttcatcttaacaccgaagttcagacctgtttcaagaggtgatacttcatcatccatctcatgtccgtaaagaggcattgcagcttccatacgaagtgtatcacgagcaccaagtccacaagggattagtccctcttcttttcctgcttcaagaagtgtctcccacatcttttctgccagatcacttgccaggtagatctctacaccatcttcaccggtatatcctgtcttggatacgatgcaaggcattccggcaacttctgcgccaaatactgcatgataatatttctttggaatattttcttctgttgtaagttttcttaagatttccatcgccttcggtccctgaagagcgatctgtccatactggtcggatacatctgtaaatgtaacctctcctgactgatgtgcgagcatccactgataatccttatccttgtttgctgcatttactacgataaaatagtgatcatctgatcttttgtatacgatcaggtcatctacagttccaccgttctcgttacacatcgggctgtatcttgcctgtccgtctaccatatttgtaaaatcgtttgtaaggatgtgctgcagattgacaagagcatcttttccttcacaaaggatttcgcccatatgagatacatcaaaaagtcctgcctgtgtacgtactgccatatgctctttgatcacgcctgtctcatactgaaccggaagaaggtatccggcaaacggcacgatctttccacctgcttttacatgagcgtcataaaggggtgtttttaattccattattttttcctcctgttattcataaagtggatatttatcgcagatctttgtaacttcggcacggatttcatctgctttggtatcaaagtctgtaatcgtcatcttgatcagttttgcgatggtcttcatatcttcttctttcagacctcttgttgtaacagccggtgttccgatacgaactccactggtcacaaacggacttgcaggatcattcggaactgcattcttattaactgtaatgtaaacttcatccagtctgttctgaagttcttttcctgtgatgttcatgttctgaagatctaccagaatcagatggttgtctgttccaccactgacaaggttgaatccttcttcaaccatggcttctgcaagtgcttttgcattcttgacaacctgttcctgataggttttgaattccggttttaatgcttctccgaagcatacagcttttgctgcgataatgtgcatcagaggtccgccctgtgttcccgggaagattgctttgttgatcgcttttgcatattcttctttgcacatgatcattccaccacgaggtcctctgagtgtcttatgtgttgttgttgtaactacatcagcataaggaaccgggctctggtgaagtcctgctgcaacaagacctgcaatgtgtgccatatctacgaaaagataagctccaacttcttttgcgatatctgcaaaaatatcaaaacggatctctcttggataagccgaagctcctgctacgatcatctttggtttgcattcacgtgcaagctttctgattgcatcgtaatccaaaacaccgtcatcattgacattgtaaggtacgaaattgtaaaggataccggaaaggtttaccggtgaaccatgtgtaagatgtccgccgtgtgccaggttcagtcccataactgtatcacctggtttgatcagcgcctgatatacagctgtattcgcatttgctcctgaatgcggctgtacacatgcatggtcacatccgaataatttctttgcacgttcaattgcaagattttcaagaatatctacatcctcgcatccgccataataacgttttcccggataaccttctgcatacttgtttgtcggtacagttcccatcgcaagcataactgccgggcttacgatattctctgatgcgatcagttcaaggtttctacgctgacggtcaagttctaactgcagcgctttccctacttcttcatcacattcagtaatgtaatttgttacatcttcaattctgttcattctcttttacctccttagaaccaactacctggtcttttttgctccctttccgatgtatttgattcagaattttatcgtttatatctgtatttttctgaatattcccttttttagggtacaaaaaaaacaggcaaaaaagttttcgtcattgaaatcttttttgtctgcctctgtccgttcacctgaaagatcacccggacttttgcgctatatagtccagactacttcttcggtacaatacatatatattgttctccagagtgttgtccgaatatgttccttttgcctgagagtttctgcttgccccttcggctcatgctatacattaaataacggtgcgcgccgtctgtacaacaagtatctcacatattcatcttccaaccttaacgttagtctcattatataattgtcgttacaattagtcaagcgttaaataattttctttattgtttattatttatcagaatatttaatagtttttccctataggcattgtttttattgactattttttaactatatcatcgattttctttgtctatttttacaaatcaaattttttctcaaaatccacacattctagccaacctatcacgattacactccctagtctctgccatttttattccaaaatcccaatttttcttcatcaatattacttattcgaaaaatctatctttcattacttcaccacatcaacctgttatactacttttttctatccacccaaaaattatggaaacctctgctgacataattttcgctttcagaggctcctcagaatggttggcacaacggaatttgaacacttatatttgtcccatttgtctcacaacctcccaaacaaactttttttgcacaaaaagatccggacttcccaaacctgggaaatccggatcttttcaaatctctaccactcaaattttttctcaaagtatgctttgagatcttcaattttaattctttcctgctgcattgtatcacggtcacgaacagtaactgctccgtcttcttctgaatcgaagtcataagttacgcagaacggtgttccgatctcatcctgacgacgatatctcttaccgatatttcctctgtcgtcaaattcacagttataatacttgctcagcattgcataaactttctcagcaccttcattcagcttcttggaaagcggaagtacaccgatcttaaccggtgcaagttccggatggaagtgcataacggtacgtgtagaaccgtcttccagttcttcctcatcatatgctgcgcaaaggaacgcaagtaccacacggtcagcaccaagtgatggctcgataacgtatggaatgtatttttcattggtctcatcatcaaagtaagtcagatcctgtcctgatacattctgatgctgtgtcaggtcataatctgttctgtctgcgattccccacagctcgccccatccaaatgggaagaggaattctacgtctgttgtagccttgctgtagaaagaaagctcttctttgtcatgatctctgtaacggacttcctcatccttaagtccaagagagaacagccagtcaagacagaatttcttccagtaagcaaaccattcaaggtctgtatccggtttgcagaagaattcaagttccatctgttcaaactcacgggtacggaatgtaaagttacccggtgtaatctcgttacggaatgatttaccgatctgaccaataccaaatggaagcttctttcttgaagttctctgtacgttcttaaagtttacgaagattccctgcgcagtctcaggtcgaaggtatactacgttctttgcatcttctgttacaccctggaaagtcttgaacatcaggttaaattctcggatctctgtgaaattgtgctttccacaggtcggacacggtacttcatgttctttgataaatccttccatctcttcatgtgaccatccgtcaatgctgtccggaatatcaattccatgctcatgtgcataatcttcaatgatcttatctgcacggaaacgttcgtgacattccttacagtccatcagcggatcactgaatcctcccagatgtccggaagcgatccatgtctgcggattcatcaggattgcacagtcaacacctacgttatacgggttctcctgtacgaatttcttccaccatgctctctttacgttgttcttaagttcaacacccagattaccataatcccatgtatttgcaagcccaccgtagatttcagaccccggatatacaaagcctcttgattttgccaaagctacaattttgtccattgtcttttctaccataacactaatcctcgcattctttttatttttcgttagaagaacaacgccacttatcgcgataacatttattcctctctgattcacctattatacctattgcatatgggttttgcaagcttatcctgctaattttcaccaaatttgtctttattttctaatctaatatacaattttccggttatttcagccctgtgagctgctccagaatctcaagcgacttgaatctgtgagccacgtatacatccagataacgccccattagctttcccagttcctttaaaacttcatcgcttaaggtaaaggtatagagcttttccaccggtgtcccgacaatgaactgcatggcataaagggtagacgtattcagccgcattccgtcatagacattctgaccgcattcactgcagaccaaaccaccctcctttacactgaacacacagggacgttccctgttcccacatctgacacactgaaatacctgcggtccttccccactgacactgagtgccttcagttcaaatatgtagcgtaccagctcaaatggaatgatctttttcgtcaacacacgcatcgtctgataaagaagcttcagcatttcccgctcgtcattggcttcccttgtataaaaatctgcaaattcgagaaaataaaatgcatagtatgccgcttccacatccgtgcggagctctgcaaaataattttcgatctctgccgactggagagtgttggaatttcttccttcatacagcatgaattttccgaaattacaaggtgtacaagcccctgcaagcggactgttcggtcgtctcgccccttttgcaaacgctgatattttccctttttcttttgtcaggatcacgactcttttatcatattcaccaatcggtgctaccgacagaatcatccctgtcattgttgttaactgattcactgcatttgtccccgtatttctccgttttcgctttgcagacttccttttcccggtaggagagataatcctccacccgtcctgttcttgcaaactgatcccagtattcctgattcatccttcggtcacctcatctttttcttatgccttttaagattaggttctcccatattttcagatgctatactgcgtaatatctgccaactgtttttcagagaaacaccttgacattttttactcgtcttctcggtatccaaagtttttgatcaggaaatcactgtctctccagtctttctttacttttacccaaagctggagatttaccttacattcgagcatctgctcgatctcatatcgcgccgtactgccgatctttttcagcatggatccctgcttgccaatgatgattcctttatgtgaatcacgttcacagatgatcgttgcctcaatatccatcacttttttgcgtgctttcatcttctcgattgataccgcaattccatgtggaatctcctcattcaggcagtgcagtgctttctcacggatcagctctgccacgatctgcctttccggctggtcggtaatggtatcttcatcataaaactgcggtccatacggaagatatttcatgatgacctttaaaagctcgtctgtattttcaccggttcttgcagataccggaacgatatctgcaaactggtatacttcattgtattttgcgatacacggaagaatgtcttccttcttcacggtatctgccttgttgatgaccagcacgacaggtgttgtcaccttcccaagctgctgcacaatgtgctgctctccggctccgataaaggtacttggctcaaccagccacagtaccacatcaacttcatttaaggtgcgctctgccacatttaccatgtaggtcccaagcttgttcttcgccttatggattcccggtgtatcgacaaatacaatctgtccttcatcggtcgtaagtaccgtctggatccggtttctggtagtctgtggtttattcgatgtaatagctatcttctgaccgatcagatagttcataagggtggatttccccacattcggcctgccgatcaacgttacaaatcctgatttaaaatctgctctcatgcattctccttctaaaataaattctcaactgtcataaataattctttttcttcttctatctttgcttcatttccgatcacacagatctgatcatttgcaagcactgcacgcgccacacctgcaagtgcgcggatatcctcctggtttgctgtaaggatctgttctctttcttttctgatcatctctgcactgacatgattcatataaaggttcatggaacggtctcccttggttgccggagtcatcggctgatcaatgttgctgatcgttccgataatatattttgtcatatcgcgttcgctgaccgtgaagttctccagatattctggaactccgtcgtagatttccagggttcttccaagattcgggtcacggtaagatacaaaatagccctcaccaatgcggttgaagttactcatgcagccatacgcaccaccttttacgcggatattgatccagaggtattcataactcatgatcactttcaggatctgcagtgccccgttatattcctcccctgcgtcgataaagttgcctgcctttgccgcaaactgtactttagaagaagttttaaatccttcattcttcttttcacagtgcaggatgcatcggctctctggcattctctccggataaagagcttcttttaagcttccgatctcctcttccaaaacggcaagtccctctcttgaggctgtgtaactgatcatcacattgccttttctgaaaagcaattccgacaaagccttcaatccgctgatgatttcttctttcttctcatcaaaatgttcttccatctcacggatattctggtaatattctattccattcgtcgtatctttaaattttgaaatcggtgacttataagacattgcccggagtgctactgcggaatgtcctgcagacaggaaacgatcctgtaatctggtctttgtcatagaaagaatctctttcagacgtttttcatcatccagtttcgatgctgtcagaatctctttcatcatacggatggcaaatggaatctgtccataaagtgctttccctttgatttcaaaagttgccttgaattctttttcttttactttcgtcacatccgggtaaagctccagtgaagttccgattcctccggtgtgtctgttgatttcattaaaaagttctccatattcataatgctcagtgtcaatgattccgagaactgcctgcagaagccccaccatcgggagatccttttccggcacatccgaaaggtcaaacatcagatccagataaccgatcccgttcgtctcaatctcatggaataccgtcgggatatctgcaatcttcatctcttcattataaatcggtgcgatctcgcgggaaatatccgctcttgtcagcatcggtatcttctccaaatcctcctgacttgacggttcttcctgatactcctgtaaatgctttgtatctgcaaccagcttttcgatttctcccctgctaaggccttctttatatacctgcagtttttcttttaattccgcatccaatctggctgtacgtcccggttccggcacgatcgtgaccagtgctccatgctggttatccaaaagatatgtctgaatcagcttttcaaaatacccggtattgatctgttcttttaagaacgcaaaggtgtccagtgcctccacatggataaacggctttgtctcatcataaagccagctgtcaaatatctgcagaccatacatcagtccctttggatagcctccgaagtctgcttcacggtaacggaattcatggtaattgattcccgcttccagtgcctttttgtccattccgttttctacgatagccttcaatgtatcttcgatcacttttacaaattctgctttctgttcttcattggcattctttgccacaatggagaagatcggctgataggtgctgctgtcatacgacccgctgatatcttttccgattcctgcttccagaagtgcttttgtaattggtgctcccggtgcagaaagcagtgcataatccaagatctggaatgccagatacagcttttcatccagagaagtcccaatgaccttattgtaggaaagataggtgttatcttctgtcgattcattacttgcgatcgaatacggctttgtgatatcatgcatttgctcaaacggcttctgcagatggatctcagaatctacttcttttctatcgtaagcagacagatattcctgatccagccaatttaatttctcttccatatccatatttccatagagataaatataactgttggacggatgataataggttctgtggaaattcagatattcttcataagtcagttccgggatcacatccggatctccgccggactcatttgcataggtcgtatccgggaaaagagaattcaggatcatacggtctagaacaccatccggtgaagaaaaagctcccttcatctcattataaacaactccgttataagaaagctccccatctgcttcctccaggtgataattccagccctcctgccggaagatctcttcgtgtttataaatattcggatgcagaactgcgtccatatacacgtccatcagattctgaaaatccttttcattacagcttgcaaccggatataccgtcttgtccggataagtcatcgcattcaaaaaggtgttcaaagatccttttaccagttccacaaacggatccttggttggaaacttttccgagccacacagaacagtatgttccatgatatgtggcactccggtactgttcgtggtcggtgtgcggaatccgatattaaatactttattttcatcatcattggagatcagaagcaccctcgcaccgctctttttatgtcttaaaagtgctccttccgatttcagatccggaagaggtctgtgctcaatgatctcatatgctgtaagctttgttaaatccatatatgatttcctccaagttctgtagttagtctcataaataacattgtacacatttctttgatttgatacaaggtcttggtgggaaatgttttccatatgttttccataatccgatgtaccttcccagttcttcatgatttttccgtcaactatgagaaacacgctccgcgagtttctcaagttatcgcgtcagtcaccaaggtctcgtgcaagcacggactttgattcattactcgcgtaaataaaataaggaatagctacgaaagccattcctcattttttctattatgcttctttcttctgtaaaaaagctgctgtctgctttttctgtgaaaatttcatgaatgtcacaaaggcaagcatcatgatgattcctgctggaagtgcgatccatgcactctgtacgaatccggcaataatataagtgataaacgagattgccgcgcagcttgccgcatatggaagctgtgtattgacatgattaatatgattgcactgtgcaccggcagatgccatgatcgttgtatccgaaatcggtgaacagtggtcaccacaaactgctccagccatacatgcggagatagcaatgatcatcatcgtctcattctttccttcaaatgcatgtaccacgatcgggatcaggattccgaatgttccccagcttgtaccggttgcaaatgcaagaaagcatcccacaaggaagatgattgccggaagaagatttaccataccttccgcacttccggctacaatgcctgctacatattctgccgctccaagactgtcggtcatagatttcagcgtccatgcaaaaacaagaatcaggattgccggaaccatcgccttaaatccgtccgggagacatgccatacactcatcgaatttcagcacacgtcttaccagatacagcacgattgtgatcacaaaagcaaagaagcttccatacaccagtccctgggaagcatcacttccagaaaatgcttctacaaaaccgactccgtcaaagaacccaccggtgtagatcattccgatcacacagcagatgatcagtgaaatgatcgggatcagaagatccattacttttcctttacagttatccactgcctcttcctccgtatttgcatacggtctgtccggtgtggtgtaaatatcacctttttttgcattatcttcatgaaccttcatcggaccatactcaaccttcatcacaaccattacgatcatcatcaggatggtaaggattgcatagaagttatatggaattgcacggataaatattgaaaatccatcttcaccttctacaaaaccggtaacggctgctgcccaggatgaaatcggtgcaatgatacataccggagctgctgttgcatcgatcagatacgcaagcttcgctctggaaacattctgcgcatccgttaccggacgcatcacgcttccgactgtcagacagttaaaatagtcatcgataaagatcagcacaccaagaacgattgttgcaagctgtgcaccgacacggctcttgatatgggaacttgcccattcaccgaatgcggtagatcctcctgccttattcatcaggcagaccatggttcctaagataaccagaaaaatcaggattccgacattatagctgtcagaaagaacacctacgatcccttcctgaaaaatatgggtgatagttccttcaaaggaaaatccggaataaaacattccacccactaaaatccctacaaataacgagctgtacacttcttttgtgatcagtgccagtgcgatcgcaaccaccggtggaaccagtgaccagatgctggcatacatcttcggtacatactcttccgcgtctgctgcaaaagcgacaaggggacttgccattacgcagatcattatagctgcgagcagactgcttaactttttcattttttctctcaattaaaaaacctcctattttaaaacataaaaatgccatgaataacgcttgcaccgtcaaaacgcattcatggcatgtatagtcttccttaaatgttcttccgatagcgctccacatgtgtgacagtacgctgcatcttctgcatcgtcccagaaaccggggttggggttccggctccttcggcggtatttcctttctcttctgtcggcttccctgccgcatctttcagaagatactgataaatcccgcgcctctatcaagctgaatattcatcattttctttatcaaccatactataaaattttcatttttgcaagagataattgctatttatacataaatttccagtccctttccaccacataccactcccagacttttgaatgtgcaacgacaaaaggagtcagagactttcgtccctgacccctattcaagtcaatcttattcttcagaaccgtacagtgtaacgagtttctgcagatatgcatatctagcttttgcttcttcttcgttcttagcaaacagaactttagccttttcaggattgaatctagcaagagcgttgtaacgaacttctccgttaaggaagtcttcgtatccagcaaggtctggtgctttgctgtcaagagtgaacttagatccttcagctgccggattgaaacggaagttgttccagtatccacattcaactgcaagctgttcttctgtctgagctttgctcatgcctttcttgataccatggttgatacatggagcgtaagcgatgatcagggatggtcccggatatgcttcagcttctgcgatagcttttacagtctggttgaagtcagcacccatagcgatctgtgcaacgtatacgtaaccatagctcattgcgatagaagcaaggtctttcttcttagtttcttttccgcctgctgcgaactgagcaatagcaccagtcttagtagacttagaagactgtccacctgtattagagtaaacttctgtatcgaataccattacgttgatgtcttttccacttgcaagtacgtggtcaacaccaccgaatccgatatcgtaagcccatccgtcaccaccgaagatccactgagatttcttagcgaggaagtctttcttttcaacgatatctttgcatgtcgggcagtcgcatccttctaatgcagcaacaagtttgtctgtagctgttccgttagtagctccacatccgtatgtttcaagccattcgttgcaagcagcttttgcttcttcgctggctttatctgatgcagcaacttcttcaactttcgctttcagaccttctctgattgctttctgagcaagtaacataccgtaaccaaactcagcagcatcttcgaacagtgagttagaccaagccggtccctgtcccttagcgtttactgtgtaaggtgtagacggagatgagttaccccagatagatgaacatcctgttgcattagcgatgtacattctgtcaccgaataactgtgtgacaagtttagcgtatggagtctctccacatccggcacaagctcctgagaactcaagcagtggctgtttgaactgagatccttttactgtattttctttaaatttagcaacaacttccggttttacttcgatttctgtaccaaagtcaaagtatacctgttctccagcgttctcttccatgttacccataacaagagctttttcacccttcttacctgggcagacatttgcacaagagccacatcctgtacagtcataagctgatacagtcattgtgaacttcattcccggcataccgatcatgtcgattgctttcagtccttctggtgcttttgcaagttcttcttctgtaagagctaccggacggattgcagcgtgcggacatacatatgcacaacggttacactggatacatgtttctgactgccagatcgggatatctactgcgataccacgtttttcgtaagcagctgttcctgacggtgtagatccatctacataatctttgaatgcagatacaggcagtgtgttaccttcctgagcattaaccttagactgaatgttcttaacgaatgctactgcatcttctcttccacccttaacttctggtgtgaacagaccttcgtcttcgcagttcttccagctttccggtacttcgattgcgttaacctgcttagctccggcatcgatagcatcgtagttcatctgtacgatcttatcacctttcttaccgtatgtagcctttgcagctttcttcataaggtcgatagcttcttcttccggaatgatgttagccagtttgaagaatgcagactgaagaactgtattgatacgtccgccaagtccgatttctttaccgatcttgataccatcgattgtatagaatttgatgtcatggttggcgatgaatgctttaacctgtcctggaagatgtttgtcaagttcttctgctgtccatggacagttaagaaggaatgtaccaccatctacaagttcctgaaccatgttgtatttgttgatgtatgacgggttgtggcatgcaacaaagtttgctttatgaatcaggtaagtagatttaatcggtttcttaccgaaacggaggtgagacattgtaacaccaccggatttctttgaatcataatcaaagtaagcctgtgcatacatatctgtgttatcaccgatgatcttgatagagttcttgttagctccgactgttccgtcagctccaagtccccagaacttacagttgattgttccttctggtgttgtaaccagtggagcaccaacttcaagagaaagtcctgttacatcatcaacgataccgattgtgaatttagcttttgcttcgttctcgaatacagcaacaacctgagccggtgttgtatctttagaaccaagtccgtaacgtccagagttgatcttaacagcgtcgaatttagttcctttaagagctgcaacaacatcaaggtacagaggttctccaagagatcctggttcttttgttctgtcaagaacgttgatgtacttaacagtatccggaattgcatctacaagtgcctgtgcgcagaatggtctgtaaagacgaactttaacaacaccaaccttcttgccctgagcaagtaagtaatcgattgtttcatcgattgtgtcacaaacagatcccatagcgatgattacgctttcagcgtcttctgcaccatggtagttgaacagtttgtagtttgttccgatcttagcgttaactttgtccatgtattcctgtacgattgccggcatagcatcgtagtatgggttacatgcttcacgagcctggaagaatgtatccgggttctgagctgatcctctttcacatggatggttcgggttcagtgcatgtgcacggaattccttgattgcatccttatctacgagatcttccagatcttcgtaatcccatgtttcgatcttctggatttcgtgtgatgtacggaaaccatcgaagaagttaatgaaaggaattttacctttcagtgctgcacaatgtgcaaccggtgtcaggtccataacttcctgtacgctggattcacagagcattgcgcatccagtctgacgacaggcgtaaacatctgaatgatcaccaaaaatattaagagcgtgtgaagctactgcacgggcagatacgttgaatacacccggaagctgttcaccagcaattttatataagttaggaatcataagaagtaagccctgggaagctgtgtaagtagtagtaagcgcacctgctgacagtgagccgtgtacagtacctgctgcacctgcttcagactgcatttctgttacctgaacagtctgaccaaaaatattctttcttccttgtgttgcccattcgtctgtggcttcagccattacagatgaaggtgtgatcgggtaaatagcagcaacttctgtataagcataagaagcatgagcagctgcatggttaccatccatggtcttcattgatcttgccattttctttgttcctccttagattgtgtcaaaacttttacttgtgttaaaatttttttacactttcgttcgatattattatagctgttcatatatgaaaagtccagtcattttactgttctgattgttccttttgacgtacaacccctgtatttcacagggttgttttatgcaaactgtagtaagttttaactatcctatattataaaagagacggacatctgtccgcctctcaccatacattatcaattactttattaacgactattatacgttgaatctgaacaggataatatctccgtcctgtacaacatagtccttaccttccagtcttaccagacctttttcttttgcagcgttataagtgccacatgccatcaagtcatcataggatacgatttcagcgcggatgaatcctctttcaaaatcagaatggatctttcctgctgcctgtggtgctttcgttccttttttgatcgtccatgcacggacttccggttctcctgctgtcaggtaactgatcagtccgagaagactgtagcttgccttgatcagcttttcaaggccagattccttaagtcccagttcttccaggaacatgctcttttcatcatcatcaagttccgcgatctcctgctcaatttccgcacagacaacgaatacttcgcagtcctctctttttgcatactcacggactgcctgtactcccgcattacttgcaccatcatctgcaagatcatcttctgccacatttgcagcaaaaatgaccggcttgtaggtcagaagattgtagctttccagccactgctgttcatcttcgtcattgatatcatcaaagctctttgccatctttccatcttccagatgtgctttaattctttccatcagtgccagctcttttgcaatcgtcttgtcatttcttgctgctctgactgctttggaaattcttctttccaggatctcaaggtctgaaaagatcagctccaggttgatcgtctcaatgtcacgcagcggatcgatacttccgtctacatggacaatattgctgtcctcgaaacaacgtactacatgaacaattgcatcaacctcacggatatttgcaagaaactggtttccaagaccttctcctttggatgcaccttttacaagacctgcgatatctacaaactcaatcgctgccgggatgatctttttggtgtgatacatctcaccaagcacattcagacgttcatccggtacagtaacaacgcccacatttggatcaatggtacagaatgggtagttggctgattctgctcctgcttttgtcagtgaattgaataaagtactttttcctacattcggtaatcctacgattcctagtttcataatatattcatctccttcatttttcctttattttactggctttccgcgattcgtgtttttaaccgagtaccacatcgagtaccacggagatgaatttcgcatcaagttttataccacttttaacgcgtcagccactaagtcaatttctctatgtttttcatcctctgtaatatgaacatacagattcatggtaataccgatattagaatgacctaaaatcttctgcagagtcttgggcttcattccaccttcaatgcaccttgtcgcaaaagtatgtctgagtacatgcattgaaaatctcggaatacctacacggtcacaatacttaaaaagtcctgtatcataagtactgttcttgaccggcgttccctttctgcaaagaaagacaatatccttccattccatcggcacgagctttaagctcttattctttgatctctgattttcaagaatacaaattgcttcgtctgtaagaggaattgtacggtagccggatttgctcttaggtggaccaactctccattcacctaccttatagcgatattccatcgtcctctcaatcttcatggtacgattttcgaagtcgatatcactccacttaagtcctataagctcacctgtacgaagtccggtctgcaacacgaagcggtactgattctcatagctgtagccaaccacagcttctaagaactttttctgagcgtctatcgtaagagcttctttcttatctgaaggctttcccatatcgctctttaacgacttcttacagggatttgcaatgagaacatcattttcccttgcgaactcaaacatgttgtaaagagcgatccgcgtctggtatatggtagtcgtcttatagccctcatcagccatatccgaaaaaatcttctggcagtgaatgggctttacatcagttaagagtttattgcctataacacccttgatattacgctcataccgttccgaatagtttctgaccgtattaggtctcactgtctgcttttttatccctatccaataatcgaaccaggcatcaacgagcatatccgttgcctggtcgaggtcactgtgttggtctatgtatgtagcatcagcaagccactgttttacctcttgaagtttcttggatcttttcgttctgcgcttcccaaatttatcaacaaatctggcgaaataagtcccgttaggttgctgaacgattcctgctccaatctcctttcctttgagatcttttcccatttaaggctcctttctaagctatatgagccccaaattagcacgttatattatacaccaactagagctcaaatgcaatgttatttcatttttttgatagctgataaaccgcgtggttaccccatttgttgggaatacgctatatctctacgttgtccgaaatgaacttttcaacttcctttcgtttaacaagttttttcttccctacatacagaacaaaaggacatctcggtgatctgagcaagctctccaatttattgataccaatagtggaatactccgcagcctcttttatagtgagtgcgaccttacactgtataggaagcgcttgatgtatgcctctttgaaggaagccgccttcttgcctctgtaccccattaccaagaacacaaagccatcacgtgtcatgttgaagcaggcctgtctatgcccctgcaagttggtgtagcttgactcctcaaaattgaggagtcggaactcttctgagcagtcaagatttctgatatctctgactacgttgtcatgacgtttctcaaaaatctttgctaccacaaggctgtccgctctcacaacaccgttaccgtccgcgtagataccaagttcgttttttgctactaaattctttttcattgcttttcctttccgcctgtgacctgcggtcgggatacaaaaaggagccggtagctatccaccgactccactaaccccgaaatggcataagaagtaacggtgggtgcttcggagtcaagactcggttaatccgaaatctcgaatctccttatgcatcccgccgccttaatggccatctcaggcattgagattatttatataaagttccgtcttgcctacaaagtgcttaaccaaacatcctgcaggacaatttcgttatatcaaactcaagctctatatccaaccaattgtaaacagcaatataaaacatacaacaacggccgctccgatgatccccacagcaagccattgagtcgctatcacagataaaataagaagaataatcataggaacaaataacaggcttgcagccctgcaatacaaccatgaaatagcagttgcaaataaacgaagtattccaaacagcaatatcataggaagtgcgataagtaccttaactaatctcatgattaaatgccccctttctcttctcgttaagaaccttataagcaatcaaacgaagaacgtactctggcataacacgacggccaagttcccattcctgcatcgttctgtaaggaataccaagccaatcggaaaaatccttacggttcataccggactgttctctgatcattttaaaagtataagccatcttacgacgctctgcttcggtatcatctttggaggttctttcaacctcgatttcaattccttctacgttataaatctcagtcttcataagcactctcctttacttgtgtagtcagtgcgtgtatcctactataattataatgtagtcattgactacacgtcaaggtaaaaaatagtggtcaggataaacccgaccactgaatatcatgcaacagcctttgttactgtttcaacaatactatcatagcatacgctctggataacgcgattccaatgcctgcgatctttgacatcaccggcgagtatttgatcacaaagctcgttcagcttttctttgctaactgcgccgctactctcagccatccaaaagataagctctccgcattgaatcgacttattaaacggtgcctcatcctcagactgaacactccatgaatatatcaaatgccaatactgagaaggttcttttactcccgagcgcttagcattcaatatatatccacccgctggttgcacatatccgccgctaatcaatctatctgtgatagaatggtcaacgttttctttatcaatatagaattgtcgtacctgtctgttaatcatcttacttccctccacacttcttataaacggttgcctgatgcgccttgcttgtagattgaatcttctcgattttaccttcatcaacaagcatcttcatctgtgatgctgcggtcctttttgccgaagttgtcatcttggcccattctggtccaaaaggtgtagaacatataaatgtttcgtcttttaccttttcaagatacttctcgatcttctttcttatctcttttacattcggtgtctcagtccttggcatatccaaaaataaggtcgtagcatattcaattagcttggatgtgctcatacctaatttctttgcctttgcctccaatgcctcatattcatcatcattaaagctgcaaaaagctctatgcataaaaaccaccttctttcaaaataggattgatgccgccactcctacttgaatataacacataggtttgataccgtcaaccctatttgaaatagataaaaattatatgcttttcgcacatacttttatcatttataatttatatatgcagaaagcatatgccatttagttatatctttttagcatatatatccttatgcttatctcaaaggagatgacttatgtttaagaccaacaatgaaaaaataggaaagcaccttggcaacttgattaaaaacagtgaacacaagaatgatcgccagttttgcatcgcatatctcacactacgtgacggcgaagctaatcctgacgatatacagaaaatgcaaaaccgtatttgccaaataaaaaatggcaaaaagggcgttcagattgaggatcttccaatcttctctgatttattgggagtatcaattgaggatattttaagcgctgggactgtcctcactcttgtactaaacagaaaaactaattactcaatcgctttttcaaatgatccctcagaatgggaagcatatattaaaagagacgacaaacttattcttaatcctgatgagtatgacaaaacggcaattgattacgcccttgaggcaggcaattaccctttcctaaaatatctcaccgagaaaggctacatatggttcgtaggggatgataaaaaagaatactatcttggatttggtgctggaacatctataaaacgacgcgaaataggatttcttgataccttagactcacgtatgaaaaaccaggatgatcttcgctttaagatgatagccttggctatcagagacaatgatttagagatgctgaacgttcttcatgcaagagagattcctttactgtatactattaacccgatacagcattggacattaaataataagcagctaccctcttcttctaacattgagcagatgatcgacagcatcgctacaagtgataacactgccatatcgtatttctttgaagaatttgagacggaagcagaacttaactcattacgaagcacttttgtatttccgtacgccggacaaatattagattctttatcagcagcaaaagggcattcgaaagtaagctctttttagaaagggccatagagcataataaaaaggtgcagggaaaactacagaaattggtagataaaagtaaagccagctgtaaagaactctatagtgcgactccaaataacaattattatgatgaagcatatttctgtagagaggcttggagcgaatactatttttaccctgaaacaggtttcatagcatactatatgccattctattccaagaacactaccggctttattaccaatgtcatcaacgtaaccgcatcttctacaaatgcagaagtacagttccttattgatgaattaaagaaaacatacaacacctttatcaaacagtttgagaaaaaggaggcttaacatgtgtaatccaatctttgattacgatgacggagatttcatttaccagacttccggtaatatgggaatcgattctgacggtgatctgcatatgcgaataggtgataatatgtcgatggacatggacaccggcgaactacacttcaactccggttggaaaaatgatgatgacgatgataatttctagtacagagataaagccaggactttttgtcctggctcaatttacatgcatccacccatggtaagaataactttagtatgcttataacctttattcttgctattgcattccattactatataataatcgtcatcatcttctgctctaacaacaatcccctgggaatactcagttttccaaagcgggccaacaccataatatggagctacaacttcatttgttgggttaggcatctcataactaaaattgtttttaaataaccacgcatgatagttcttcaacgctggcggagctcccataatttgaaaagaagtcataatggcagtctgaaactgtaattcttcttcaagattaatcacatatttctcagtaggatctagttgatattcaccattatcattatttctactcttatctatatcattcaacgatatctttttcatatcagtttccttcctcgtttggtctagtacccgcataaggtcgcggttgcgatacatattgatctatcttcaaaaatgattctcccaattcgtttaagcttaatacaagcatgtactctgccacctctcctgcatgatctatatatcgcataggatcaagtgatgctctgaactcttcaaatgaatcccctacttcaatccactcatcctcttctttgtcataatagcaatgcaattcacgccatagtgcctcatctatttcctcgtagtattcatcatcaacaatgaaatttgcccacggaaataatctaggaaaaacatctgtatatacggtatacggaaaccaatatggataggaatacttcttaattgaattaccatcatcaacaattaattcgatttctcctttaccgctacacttattaacccattcattagaatgaagttttacttgtcctccctcctgaattatctgcataaatttcttttgcgatagcagaaaattgtagtttgttatatgctccggcaaatttgtatatgtgagcaataacttatttgagatatcatccaaaaatacctgatctgtcgggacgttaacataatatccttttccagttcctccacaggttttttgaatagtatcaaccgacaatttttgccaaatacacatatcatcttttggattataaagtacaactatacaaggcaaggtattagtggtccaataattgtactgtctgtcatctatatcacgaaaaacaacataatctcctttattctctttgaaatagctctccccactctttatttgaagagcaagaagctgttgaactttgccatctgtatccgtacgttccatatgagcatctattcctatatcatcaataggttgttctctaaacatccactctgtttttgcagctatcaacgaacaatatgaaacgcctatacgttctgtagtatttgccattttctgtcccccaatttatctataaatctatttcttcagcattaacaaaccaatccctcttaatatcagtgctatcatcaaggcgcaatatcaagttttcatcacaaacaaagcttgcgtgcttccaatctttgtatgacctaactatagcatttatcaaaaatataatagttttttctatctctgattccggtggattggctaaatcaaaaatcacttctgaaagcggaattaaatattcaatacaataatacctgctattattggaataatccgacaccatattctttatctcaagaaatctccctatattgtccacaaattcagggctccatgaaagtgaacgataatatgactgcatttccaaatgtgatctaaacgcaaatccatttacgcaataatcttgagtatcaaaatatccaagccgcgacttaatatatgccatattcccaggtcctgcataaaactcgtcatctagcgtttgtaaagcccccttgtaatacagttccatatggccattatgcttcttaaaagtaacatcatatcttttaaagaagtctgataatggtgtcttgcaaagcaacagtcgctctaagttattgtttgttcttaaatctgttccatttaaccgcctagtgagatgaaacatctggatgtactccaaaggagaatctatcccgtaatcctctaaatacttttttacccaatcgtatgggtcctcgtcaaccgaatcaattgtttcaaatactagctcaagttcttcctctgtgacatttaaaaattccattactccgtgtttaagcgacagctgatctcttgtatcaatatatatcatttacatatcccccgaaaaaaaagcctacacatcacctactcagagcaggaatgcataggcaataatagtaattattattattgtgattaatttcgctaacctgggtctcaatatagcttgttacaaatgaaataatgttgatattttttcttggtctcccaaatatcaagtaccataccgagtaccacgggagtaccatttttctataaattataataatttataacaagttacatacgagatcaaattaccacgaacccagtaaatatgcggtttcatagagttatatgactctttatggagattcatgaaaacaggcttcaaataacgatacctaatttcattttttatatttcctcctataaatcctttgattttcagtataattatctaaattcagtactctgtattataccatagccttttctctttgtgaatatttaagtttctgttttctttacacttgtaagcaaccttatttgtaaaacttaattttctctaagaaatttgttgcgcctgccgccaatggcagatcgttcttgatgaaaatttttttcggttatttgaatacctgaaaacctaaaatactcacccattccgggtgaatgccttatcaaaatttccttattttgttgtttgatttatgaaccggcaattcgtcatacattgctttaaaaagtccagccaaatattccttactgtcaacatcttctactaacagcatctcctttgccccttcatacggtaattcataaatcgcagttgccatataagaaactgcagattttgtcggtttcacaagtaacctgtcatcatatatgcctccgacaatcctgccacgataatatatgatatattctcccatcattgcacgataattaatttcttctaaatcagataactgctctaatataaattgtaaatattctttgcttgaggccatgtttttgtcctttcaaatacctgcattttcaaattatactgtaatctcaatttgattatcttcaaccgcaacaatgcagctttcgtaatatccatcacccgtagtccgtggtccactgataacctcataaccatctgcttttaattctgccgtcaatgtatccactatttctatacttcctacgctaaaagctatatgtgaatatccagtacgaactattttcttcggtaaatcagccatttccggtaaattcattatttcaatatgtgcaccatcctcaaatgtgagaaaatacgaataaaatcctgttttctgattatgatatccagcatttgattttgctccaattcctgatgctctgattcatcgttcaaatcgtttcaccctttcaacttatctgcatttcctgtaagaaatgatccatatgctcttccagtaactttatcacttgacttttgtcttctgctccatcatatatgctataaagcaaaaaaataggtccataaaaatcaagtgctgtctgtctggcttttccttcatcgcccagcattcctgaaaacaaagcttccatataagttaatggtccgcttgcaagataattctgatatagctgtgccatctgtggctctctgtactgttccaatgtcaacatcttacgaaaacagcttgaaaattcttcctccgtccaatgaagaaactgcacctttgtgaactgcttaatcttatcaaatgccgtttctttatactcggctgtaaccttttccagatcaccctccggcatttcatactgctttactctctcaatatccaattcattcatttttttaataatactgtccaatatctcctgcttgcttttataatgcttatacaatgcagccttggttactccaagttttgaagcaatatcattcatggatgttcccatatatccactctgtgcaaataacttcaaagcttcttccaatattttttcctttgtgttcttttctttgctttccatgtctatctcctaatttaaatctgttattaagttaccttttggtaacttgtcaagtaaattataaattagtgttttctttctccctgcatcttgaaaaataacatgccgttttgcattattgttagttctgcatcgacatcattggcaaacttacggatagtctcctgtgatgtcagattatctttatctccatataatatacaagtcggaaccgaccaattgaccggatgattacgcacataacacaaatattcccaggacaatgtttctccaaatcctgtagttatcaactgtttttcacgtaacttttcttccgttatatccgcccatcccatcatgtcaagaatcaccttttccatatcaacgattgatgaaatgaaaaaggctttgtctatctgccgaaaataatattttttatcgtctgccttcaccatctgacagcaatgtaacaaaataataaataattccgaatacagctatacttcccatcataataccgatcatctgatttacacctactacatttccatgaaataccggattgcaatcaagagtggctcttatcgcttcaaccatttcatccggataatgttttctctccatctccatgaatactccgtgaagcatatgattcttaatcaatgaagtggcatatgtactcggaagataagacagtgccttctgaagacctgatccaaaatttgaaatcggcatataagcaccacatataaaaccatatcctgcgctgacaattgtacctacagccgaaagctgtccctgtgttgtcaacggaaagctaatgatacttgaaagcgtacttccaaacaggacgagcaatatcatatcaaataaaacccatactacatctactgcattcatataccatcccattttaagtaaatatcccagacataatacaaacgcaagtgtattgaccatcaatgaattagctactgttgacagaaaatatcccaaatatatttttcccttgctgacaggcgaaacattaaaatccttccatgttccatttgccttgtcctgcaccatagtcagattcacacaaaatgttacagtgatacagctcactgccataagtgatgctgtcagttgtgctgccacagttccattaatgagcttatccgaaatcgtgatcatatccggaatcgctgctgtaaaagaatctctgaaaacttttgcaagaaacgtagcatacagaacaatcagaatgacaggggtgatcattgatgtaaacaacatccctttatctttaaaaaacagtttcctgttcctgttcattaatgccaatactgttctcatcagcgttcacctccaagcttttttcctgtgactgcaagaaatacatcatccattccgccttttactacctcataatccctgaataggtcctgatgttctacaataagctccgtagcttccttcgtatttcttacttttatctgatatccgtcacgtatttttttatattctctgttcaatgactttatttcatcttcggaaacaccataaacagatactatatcctgtacataatcatttttaagttcaaacggtgtaccttccgctgcgatacttcctttgtcgagaatcacaacatacccggcattagcagcctcttccatataatgggtggttagaaatactgtcatattttcatttttctgtagcttctcgataacattccagattaattgccttgtctgtggatcaagccctgttgtaggctcgtcaagaatcaaaatttccggtctgtgcaataatgcacgggcaatatcaatcctccttctctgacctcccgacagcttacctacaggtctgtttaaaaactcgtcaaaatccagaatttcgaccagctcctgtaatctcttatcaaaggcatttcctgtaatgccgtacaaagcagctctgctcattaggttctctttcaccgtaagtggtttatcaagtacgctatcctgaaatacaacaccaagcatcctttttgtctgtgcgccggctttgtcagtttctattccgtttacctgaaccgttccactgtcttttttcagcagtccacaaagaatagaaatggttgtacttttccctgcaccgtttactcctagaaatgcaaacaattctccttttttcacacgaaagctcaaatcatttaccgcttttacttcgccaaagcttttattcaagtggctgattttaatgatatctgattccatatcttctccttatattttcatttttccttaaatgctgcagcatatgttggatttatcttttaaaataaaatccatatattaaaaagtaatatgaatgcaaaaattgtccatgcctcttggcagttaccattcggttacttatattgtagtaaccaattggtaacttgtcaatctttttctaatcttatatcacttctatcggatgagcatccgaaacataaatcatcggatcatatgaataaaaaatatatttttttcgcttgccgttttcgttcttcacttgttttgttataagccattatctttcttccgatctgatttttggtatagaaatcaaatcggagcatggcggtgaccggatatgtggtatcccacaattctcaaaaaatgtcgaaaaaaagtgttgcaaccagtatgatgattacaacactttgttcattcttattgtttaattctttttgctggacccattgatgcaaataccacttctcctattgctcatgtctcccctcaaaacattacatttagaagcatatgacataataattaaccactgccccatattataaataccacccagagatacttatttcagactgataatcagatttttattgaatttattaatctatatgttatgacaacatatctttcagacatgtactccggtagtcactcggtgatattttatatctttctttaaatactcggttaaatgttctctgactttcaaatccactatccagacaaatgtttgtaatagaatcactcgtattttccaaacgctggcatgcatagttcagccttacatcgttaagatattgattaaagtttctatggaatgttttggaaaagagtctggataaaacatatttgctcacccccagatcttttgccatctcttccagcgaaaatttcttcttaaaatttgctgatatataggaaactgtctggtaaataagatcgttgctccccacattactcttttctaccaaatttaattttcctatgcagcgtgccaacacaatttgaagatatgcctgtgcaacagtaatatccgactgttctgtctctaaaattgcatttataaccctatatacctccggttcaaccttttccgctttgatgatggggtattcaggagccatggattgcatgatatctgcaaatttggctatcgtaaatggcgatgcaatcagataagtcgctttatttacaccgggtgtcagtacctgatagtgatgaataacatctggaaatacaaagcctatatctcctttttccatatggtatagttcctgtccgacaccaagttctaatgatccacttgttacacaaacaatctccagtgcattatgaagatgtggttcaatatgttttgacttcctatttattgctatgatctcctcttttgtgtcaacatattttaactgcatgaaatactcccctttgcaacatttgtctatatcttctttcgatttggcaagcaatccttttacacctatcttataatcaacttgtaaataaggaaaggaggaattgcaaatgagcaacctaaaaaaatatctgaatgaccttttagtattctacattgaatattttgagcatccttaccatgtataaatactaaaaggactattttgtgaaaactgaatattttcttaaggccatttcacaaaaatgaagtggtccttttttattttcaaaatacagttcaatcactttatatatagaaaaaagcactgtctcatcgagcaatgaccagacaacgctttctcctgtcaattctaatttatgtctgatgcatctgttacttcatctgtagcaattcctttttctgctttcagttttttatttgcatcttctacattcattcttgaaagtgcaaacataatcaatacatcaaagattaacggaagccaaagatacataaactgcatcatatcaagtgcagactgcggctgagttgcatttgttccgatatatccactgaactcaagcagccatccaacaacagcggttccaatacctccaccgatttttacgccaagagaagtacaagagtacatcgttccgtcaattctctttccctgtgtaagataagtgtactcagagcaggatgcgataactgcattcatatctccctgccatggtccctgacctaaggctgcaagagctgtaaatgccatcatcagcggaacactgcccatatatccggcaacaacaacaagtgctctaccgatgactgctaagacataacctcttaagttcagtttatacatacctttccacttaccaactaatgtcggtgtgaaaaccagggcaatgatcagtggaatatttactgcccatgcaaattgtccaaacaaattcttatttttcagtacccatgtcatgtaataaatgccagctccaatcatggcaccatataactgctgtaaaatatatgttccacaaatcatcatgtaatatttgtttttaacaagaagcttgaatgcctgtaccattccgtacttttcattatcatcctttacttctccttcgttaagttcttcctcaggaagttccttaacagaaagtgctgaaatcgtatttacgacaagaccaatgattgcatagataatagcaaccgttctccatgctgcagcatctccaccacatttatctacaaatccaactgtaattgcctgaatcagaagacttgttgaaaacgcaaaaataaaacggtaagatcccatctgcacacgctctttgctgttctttgtaatcagtgacgtaagtgctgaataagcaatattgtttgctgtataaaacacaccatttaacagtgtgtaagagataaagaaccatgcatatttagccgttgttcccaagctgactggtactgcaaaacagcagaccagcgtaatggcacaaccaatatatccatatagcatccagggtttcgcttttcccattttactgtgtgttttgtcaatcattgatccaaaaaatatatccgtaaaaccatcaaatagttttgatacggcaatcagggtacctacgacacctgcagcaagtcctactgagtccgtcaaatagaccatcataaaagatgtcaggaacgcatagactacattacctgcaatatcgcctgatccatatccaattttgttataccatttcaaatactttttttcttccatcgaatttctttgctcctcatcttcatcgcacttagaatttcaagatgtctaacagagtatgatgtctaattctagttttttctctgtttttgtctgattgctctgtatatccggactttacataacaatcagactctctttccttgtttacaggttacatgaaactttattatccctttatatacggtatcagtgtaaactggaaccggaataatacatcatcaaatcggtactgctccaatacaactggaccacaactgttagaaccaatgccatttagtgcatagtcaacacaaaatactacactatctgattctgtcagttcataattatgcgttttctcctcaagttcttcctgcgtataataagaagcattgaatgagaaggcattttccgcagagaccacaattccatatcggctgttgttaagctctacatattcacaatcataatggcttccattttcctgtgggcgaatataatcctcatgcaaatcatctacatttgcctgatacaagccgtggctcgcagcctgatgtttgtcacaatagctttcctgtggtcccattccaaagtatcgtgcagctgaaagttttttatccaggaacatcctcacaccaaatcttggcaggtccggaaattcatcatcttttgttactgcaatatctgcatcaatctttccagcagcttctattttccatgtgatcgtcacatcaagaatcttctgtactgtctctgccacaacggatgcatggcttgtaattttcacaccatgctttccctgcacgacctctgtcgtgtaagctcttgtataagctttatcataatgggctttcttccattcagacttgatgtacatatcattatctgttggtgccctccagatatttaattccatcgggtggttcagatattcccgacctgcaaatttcatctctgtaaaaagtgcagtccgtcggtcgattgtatatgcgaattcacggcctttgatatgaatctgggtatcatcttcactcacctgtaattcagaatccgtcactgttttttcaacccatttttctgctaactggcatttggcatccttctggcttacttcgatctcatcaaatccaaggatataatcctcttccagcagaggcatttcttttttcaggtggtaaataagttttaaataacattttccattttccggaacgttgacctgcaggtttgtttttccttcactatgtggtaccacagatacttcagcaagttttcctttcccaatcaaaagtccatcctgtgtcaattcatagctgattttcacataatctttcagattatcaaaatccatgtagttatgaagcaccagttctccgctttctttgtcataggaaataacccttgccgggcgataaacattcttgtattccaaaagtcctgtatgtaccgttctgtccggatatactaatccatccatacagaagttgccatcatgaatttcttcgccatggtcgcccccataagcatatatagtctttccattctcagcagttccatgagcaatcgcatggtcacaccattcccagacaaaaccgccacacattttatcattatcctgaatcatctggaagtaatcttcaaaatctccaggtccgtttcccatactgtgacagtactctaccaaaagaaagggtttgcttccatctttatccagatattcctgaatttcggaaaacgccgggtacatccggctgtacacatccagattgctgtaatcatatgtttcatcataattacgatatcttgcactctcatattgtgtgatacggtctggatcaaaattctttgtccattccagtgctttttcaaagttgcagccataagcactctcatttcccattgaccacataacaatacagaaacggtttttgtcacgttccaccatgagttttactcgatcaacgattgcctcttcccataccggatcatctgcaatcttctcattccatcgtttgaaccgattgtaatcggtgtcttcttttctgtagatcataaatggaccatgagcttcaatatctgcttcatctattaccatgaatccatacttgtcacacatttcatagaaaaatggtgcgttcggatagtggctggaacggatcgcattaaaattatgctgcttcattaacgtaagatcggttgtaatctgttccggattgattgtaaatccagtaaccggatcagaatcatgtcgattgacaccacggaatttaatcttctgtccatttaaataaataacctggtctttaatctctatctttcttaatgcaatgtgatctacaattacttcattctctgtttcaaaaatcagtttatatagatatggattttctgtattccaaagttccggacttgcgatttctaatacagctgttccttcttcagcaatacttcctagtgctacaactgctccgtttctatcttcaatcgaaatttttacatttaacggagagtagaatttcatttcaatttctactttcgcaagcatatcctcaattcttgttttaatatgataatcactgattgcctgttttgggcgtttcaaaatgtacacatcccggaaaataccactcatacggaatttgtcctgatcttccaaataggaaccatcacaccacttcatgaccagaaccgctatgctgttctctccgtcccgaaggagatcggtgatatcaaactcactggtcatatgagaaacctggctataccctacataagagccattgatccatacataaaagcaactgtctactccttcaaaattcaagaaagcttttggtgcattttcatctttgtgataaacaaaggtatgtgcatatgttccacatggaatatcctgtggtacatacggtggatcaaatgggaacggatacctgatgtttgtatactgatgtgtgtcatatcctgccatctgccatacactcggaacctgaatctcatcaaaattttctgtatcataatctttctcaaagaagggttcctgaacatcatagatactgttaaaatactggaacttccaagttccgttcaataactgcattcgatctgactcttccctgtgctccaccaggttatccattcttttggatgccggaataaaataggctctggctggcattgtattttcatgcagtatgcttaaatcctcataataacgtggtacaatcataaataactctcctttaatacatatacatttttttgcactttgtttttccacagcaaaccttgtcttttacttttatgtttactcttctctgttttgctatatatatcttatcctaatctgcaaaacatgtctatgaattggattagacaaaatatgcactaaatgatacaataacaaaaaaggaaaagaggtgctaccatatgtatatgaataccggttatttaaaccactcccatatggatttcaaagacaaaagtcgcccactggttgtaggaagttgcggtacttaccgcctttccagccatccaaagttaccaacctaccgtccaaggggacgcctggattatcagattatctatatcactgctggttgtgggcattttcattttgataatatggataacgaaacgattgtccccgccggtaatattgtactgtacagaccgaaggaacttcagaaatatgaatattatggaaaagataagacagaagtatactggattcattttacaggcaacaatgtaaaaaatatcctacggcaatatggattcccggataaagagcgtgtatttcaggtcggaacctctatggaatacgaacagattttcaagcgtattatcatcgagcttcagcgttgccaagataattatgaggaaatgcttgtccttctgctccgtcatcttcttatcatctttcatcgggaactgaccagggaacatatctcgaaaaatgaatacctggatcacgagatggataacgcagttacctttttcagtgaaaattataaccagaatattagcatagatgattatgctgcctcacgtggaatgagtgtcagctggtttatccgaaacttcaaaaaatacacaggttctacaccaatgcagtttattgtgggaatccgaattaacaatgcccagatgttacttgaaacaacaacctattccatcaatgaaatttctaaaatcgtcgggtatgataatcagctttatttcagccggcttttccacaagctgaaaggatattccccaagagagtaccgaaagataagaaacaagttctaaaatccacaatatcataaatccagtttcccctccaaaagaggatgccactccataagcacctgacttagttccttgcccgaccgcattttatgccactttcggatgcactccctgcagcatgttgccggattgtgtccaaccctttttcagattcgtgattttttcaaaatccggctttataatcaaaaaagtactcatctcagacacctagtatcttttacgcaaaaaagccagataccattttcgaatgatatctggcttttctcttcttatacatctcttatcagtctttcgtttccataataacaatccgaccatttacaaaactgatcttcacttcatcatccacaaactggttgctcaccgtcagactgtcgcacggcatcagatcatgatgattgagcggccatttcgtaccctccaaactgaaatcataaatctcgccttccaaagaaaatacagaaagatatggtccgtatgcttctgactttttcagcacacaggatttattcgttacccagattttatttttctcatccagaatgcaggcatttactccggcatcacatgccacactaagtgtctggacattcgcccacaaatgatcgattcttccaccggttgccccaagaaggatcatctctttgcttcccagtgtaattcccagccgaagagcaatctctgtatccgtcgcatccttaaccggattatattcccggatcggaatattcgtctccttgcgatagtaatcaatcacctttggatcaatactgtcaaaatccccaacaatatactgaggctcaatcttatggttatacagatactcaagccccttatctactgcgataatataagcctccggatttgcttcaagaaccttctctgcaaatccctcatcaagcattcccccactgataatgactgtcttactcataattctttaaaatctccatcaattctcttgtgttttctcctgcattccctttgaatacagctgatcccgcaacaatcacatttgctcccgcatccagtgcttctttcacattgaatgcataaattcctccgtcaacctgaatatcagtctcaagtccacgttcattcagcattgccctaagtgttctgaccttatccagcatctcaggaatcagcttttgtccgccaaatcccggatggactgtcatcacaaggaacatatccacttcaccaaagaattccttcaggacctccaccggtgtatccggtgaaattgccagtcctgtcttcatgccacacgctttgatcttgtccagagtcgcacgtatatccttgcatgcttcataatgtacagtaagaatatccgctcctgcctctgcaaatgcttccacataacggattggttccgtgatcatcagatgcgtatctatcatctgctttaccgccggtttgattgatgcaagcacaggcattccaaaagaaatactcggtacgaacacgccatccatcacatcaaaatgtaaatataccgctccattttcctctgtctggcggataccttcttccagattacaaaaatctgccgataaaatagatggtgataatttatattccattttagtttagtacctccttttttccttctgttccagttcccgatacatctcacaataatcttcataccgtacctgatgcacttttccctcttccagagcctcttttaccagacaccccggttcactgatgtgattacacccctgaaacctgcagcctccctgatactgatcaaactccggaaaataatatttcaattcttccttgccaaaatcattggtatacagtgacgaaaatcccggtgtatccatgatataggaatcctcgtcgatcgggatcagttctgaatggcgggtagtatgttttccccgctcgatctttctgctgatacttccggtctccatattgacattttcctgaagacagttgatcagagaggattttccaactcctgaaggtccggcaacagttgttgtctttccttttagtgcctctttaatctccagaatattttctccttctctggcacttgcaaagatcacacggtacccacaagcctcataagtcttctccagagactcgatttccggctcatctgcaatatccttcttgttgaaacagataataaccggaatctcctgccgctccatcataaccagaaacctgtccagcagattaaaatgcggatccggcttcttcactgcaaatacaaccagtgcctgatcaatatttgccactgccggtctgatcagttcattcttccttggaaggatccggatgatattaccggtcttctcttctgcatctaagatctcatattctaccagatctccgaccagtggtttaatcttctccttacggaaaattccttttgctttacattcataaatgacagattctactacgtcataaacgtagtagaatcctgcaatcccttttataattcttccctgcataaaacagtccttttaatttcctgtattgttgccgttatttgagttgttaccggaattattgctgcccgaattgttactgtcggatccactgcttacctgtgagccattgcttacatacagtgtgatcgcagttcctacatctaccgatgtaccttctcccggatcaacttttacaacttttccagatggttctgcactgtcaatatcaacttctgtataagtcagatttctggcattcagtgctgaaatcgcatctccaagtgtctttcctgtcagagttggtaccttcacctgatctgcaggctttggccctttgctgacaacataactcacacttgttccttcagccaccttcgttccggcatctgtgctctgacggataatcataccttctgcataatcatctgaatattcttcactactcgttccgccatcggacagtccgcttgcactcagtgtagataccgcatcatttacatacattcccacaattaacggaactgacaccttatccggctgtttttcacctttactgatatacagtgtgattttagagtcagcagatacctctgttccctctgccggatcagtccttgttgcttttccactttcaacatcactgctgtattcactggtaacagtaatgttcttgctcgtaaagccctgtttgatcagtgctttcttggctgcatcttcattcattccctctacactctggatcatgatcttttccggtcctgaacttattacaaccttgatcaccgtatttttcttgactttctttcctgcttttgtcttctgctcaataatcgtacctgctgccttatctgatgctttctcggattctacttccagcttcagctgcttcttttcgcacatcgtctctgcaacattctgcggctgtccgaccagatttggcacttcaatctcattggaaactgaaatctgactgtctgaacgcttaccgaacacacctgctgctttgccgatcaggaaaatcagcgcaaatgcaacgatcactgcaactgcaaccatgaggatcttcatcatcttgttcatcttcggatctacgccatttttactgttaccgcgtctgcccccgttataattatcctcttcgtcatcctcatcatagtcatcattttcgtcatattcttcatcgtcatagccatcatcatactcttcgtcatcataaccatcgccctgacgctttttcatacgtgccatccgctccggcgagatcatcaccgtatctcccatactccggatcggaaccatatctacaaattcgccactcggatcgaccaacgccctcttcagatcctggatcagttctccggcactctggtaacgtctttccgcgctcttctgtgtacacttgagaataatcttctccagcgccggatataaatccggtgcatactcagaaggcggggtaatattctcctgtaaatgcttcattgcaaccgaaacagtagaatcgccatcgaaaggaacccttccggtcaccatctcatacatggtgatacctgcagaatagatatcactcttctcatcacaatagccgccccgtgcctgctccggagatacatagtgtaccgatcccattgcactggtgctgactgtctgcgatgttgtcgcctttgcaataccaaaatctgtaacctttacctttccttctttggaaatgataatattctgcggtttgatatctctgtgtatgatgtgatgattgtgagctgcctcaataccagtacacatctgaattgcaatactgatcgcttccttggaagaaagctttccttttttctgcacatattctttcagagtgattccttctaccagctccatgaccatataatagagtcctcgatcctcccctacatcatatacattgacaatattcgggttcagaagccctgctgctgcctgtgcttctgaccggaatttctttacaaagttttcatcttccctgtattcttttttcaggactttcactgcgacatatctgttcagcatacagtccttcgccttatatacatccgccattccaccggctccgatcttgctcagaacctgataacggccacttaaataaatcccgtcttttaccatatactcacctcatcagaaaacggttctgcaagaacaacactgatattgtcattgcctccgttctcattcgcccggtcaatcagattctgaccggcttctacgatatctcttgcccctttaactatcgcaaaaatttcttcatcctctatcatattactgagtccatcggaacacatcaggatgatatctccctttttgaggctgaattcataaaaatccacctctacatcctcttttactccaattgctctggtaatgatattcttatccggatgatgtcttgcctcttcctcattgattcctcccagacgaaccatctcttctaccagggaatggtctctggaaagctgcctgatatccttattcagaagatacagacggctgtcacctacatttataaaataaagcgtatgatcgatcacagttgccgcaaccagagtggttcccatcccctccagattaatgtcttcatctgctttctcgatcagcttgtggttcgctgtctgagccgcatcttttaaaatctcttccggtccatcctttaatgtatgcttcagttcttctttcagaacttccaccgtatattttgacgcaaaatcgcctgccttgtgtccacccattccatcggctactaccagaagattcggcagcgtacctaatgactcatctgtggcaaacacgtaatcctggttcatttcacgttttcttccaacatctgtcatagaaaatattttcatattttatactccttgcatcgtcttgcgccgtaactgtccacaggctccgtctatatctgagcccatttctcttcttatagtaacatttatcccgtttttttcaagtttatttttgaaattctcggcactttttttgtccggtttttcgtagtttctctccttgatcgggttcaccggaatcaggtttaaatggcagtttctgtcttttaagattcccatcagctcttttgcatcttccggtgtatcgtttacgccgtgaaccaggctgtactcaaaagtgatcctccgtccggttttttcaaagtaataatcacacgcttccagaacctcatgaagctcgtatttatttgccaccggcatcagcgatcttctcttttcctgattggaaccgtgcagggaaagtgccagcgtgatctgcagcttttcttctgcaagtctccggatgttcggtacaattccacaggtagacgccgtgatatttctctggctgatattgagcccgtgctcatcactgaccatgtgaatgaatttcagaaaattgtcataattatccagcggttctccggttcccatgatcacaatattagaaactctctcgccagtgatcttctggatctggtaaacctgtcttaacatctctgacggtgtcaggtttcgttccagtccgtccagtgttgatgcacagaaacggcatcccatccggcagccaacctgcgaggatatgcataccgaattgccatgtttatatttcatcagaacactttctaccatattcccgtctttcaggcaaaacaggaatttattggtcccgtcaatctttgaaatctgtcttttttccatttcgactcttcgtatttcgtatgctgcttccagtttctggcgtaaagtttttggaagattggtcatttcttcaaaatcatccaccagcttttcatggatccaggaataaatctgtcgactgcggaatcctttttctccaatcgccagcatttcttcctgtaactcttcaaatgaatacgaagcgatatcttttttttccattatctgcccctccggataaatttagcaatatagaaaccatcggttatatcagacgggaaaatctgtttctcccattccaggtcaaattccggatgtttttcggcaaaccatccggcgttttcctcgttctctgtcctgctgatcgtacaggtgctgtacatcaatgttccctccggcttcacatatcgacaaaccgcatccaggatctctctctgaagtgctgcaacttcagtctccgtctcagggttcatcttatacttcagatcggtcttcttcgcaagaacaccaaggccggaacacggaagatccgcgatcagaacatctgctttttcctcagagtccgcatcgaagcaggttgcatcctgctgcactgcacggatattttcaaatcccatccgtgaaatattttcccgaatcagctctaccttcatctctgtcagatcccttgcctctaccatacctgtcccattcaggatctgtgccgcatggagcgcttttcctcccggggccgcgcacacatccagtatgtaatctccttctttgattcctgcctgttccgctaccatgatcgaagctgcatcctgtacctggaattttccttcccggaacgccgggattgctgccagataatcatagcctgagatcagaagcgcagacgcaagaagcggatgctcttttacctgaatgccttctcctgtcagctctctgatcagctcttctttggtggttgcatttccattgatccggattgttgttgcacgttctttataaaaaccttccaggatgtatttcgtcttctcttctccataatctctcacccacatacggatgatccattgtggcatggaatactttattgagagaaattcttctgtattctccggatacgcaatcttatcaatgtttcgcgcgatatttctgagtaccccatttacaaatccccgcaggttcttaaagcctttccggatagcaaggttgactgcttcattgcatgctgccgaatccggaacctgatccatgtatttgatctgatagaccgcacagcgcaggatattgcggattaccggtttcattttttctgtctttacttttgaaaactggttgataatatagtccagttctatcctccgctctgttgtcccttctgcaagcctggtcagaaatgcacggtcctgcttggacagatactgatatttttccagcacctgtctgagcacgatatgacttttctctccacgctcgatttccagcaggatcatcagtgcaagttctcttgtatctactccctggttattcgtcgtcatttcttcttcctcctgtcaggatcagtattcttaaaagctgcagaagtgcagatgctgcactcgccacataggtaagcgctgccgctgtaagaacacttctcgcctcacgtacttctgattcatatagcatgcctgaatttttcaggattttaagtgctcttcccgatgcattaaactctaccggaagcgtgatgatctggaacagcactgccaatgaaaacatcaggatcccaagattgataaacaatgtagacatttctcctctgataaataatcccattatgatcagcggccatgaaatcccggatccaaaattcgccaccggaacaagtgctccgcgtattgtcagcggtacataatgccttgcatgctggatcgcgtgtccacattcatgtgctgcaactccaagtgccgcaaccgatgtcgaaccgtaggtggaatctgaaagccgcagtacatggttcgctggatcgtaatgatcggtcagttttccacttactctcatcacctgtacatcataaattccttccatcctgaggatctgctccgcagccatcgcaccggtgatcccggcgtggttgcgaacctgatcgtacctggcgtaggtggaattcactttggcggatgcaagggcgcagatgatgacgccgatgatgacaaggaaataagttggatcaaaataatatgggtagtacatgtttgccgttactgaaaacttataaaaagttacaaacttctatgtttcattcctacttcaacgagtatgcttttgatgatataaatatctatctactcacaagttcttgtactctccataggcgtaaattccggactaacgtatccgtacatatttgcattaacgtttcagtgtcagcttgcaaatcgttctccataacccttaagatttattgatgcctggaaatctctgtcaattatattcccacactcacatctatattccctgtcagataatttcaaatcttttttgatatttccacaacagctgcaaagctttgatgatggataaaaccgatcagccacaataagctggatccctttatcactgcatttgtattcaagctgttttctaaaccaaaaaaatccttgttcctgaactgctttggataaatgtctatttttcatcattccgctgacattcagatcttcaatacagataaatcttggttttcgatttacgatctcagatatggtctgattcaaatagtttttacggatgtttgttaatctgtgatttcgttttaataaaagtttttcctttttgattacattattggttttgcagtaactttcccctttcttattcttctcgtaagaacgagagatactacgctgtaatctgcgtttctgtttttctagtttctttactttctgactcttattaatgttcttatatttaacagcatcagagcagacagccaaatctttgattcctaagtctataccaactccatcatcattaagtgtttccttgcaatcaggaaattccacacatacactgatccaccagttcaatccgtcaaaggatattctcggattcatatatttaacatctgttggaatacgtccatgttctgcaagtcttacccaattcattttctgcttatttgctttcctgctggaagaaaagccttcaaacttaacgtgggtattactgaattgtatcttaacattatcctgatagaacttcggcattgatctctttttagacttgaatcttgggaatttttgcaaacccttgaaaaagttcttatacgcagtacaggcatctttgattgcctgtttggttacattatttgaaatattcagcagccatgcgtattcatcagaatgtctgagctttgtaaattcttttctgagttctgaatctgaaatgaatttgccacctttttcataattttctttttccctggccaaagcccagttataagcaaatcttgaagcacctgcgtactgaaacatcttagttttctgtacgttgtttggtatcagcattacttttatggcttttaccatctgtttcctcctgtatcaattcccggataagtttcttagctttgttcgcttgttttccttgtaatttgcagctgaatactgtgattatttgaaccagatcttcaacaagttcctgctgttcagatttttcagtattatcaataatctcaatctcacaattataaagtgaagcgatatattctatcaactcaaaaccaaatcgcaatagcctgtctttatataaaacaacaaccttttcaacttgatgtagtatgatgcggatgaaattttccatttgcatcccaatttcgtaatgtctgagcagatacgcctataatttttgaaaattcgtgtatagaataatatttactcaaagtatcaactcctttcaataatattctagtctaatatcttataaaactcaatttccacttatatgattttataatttatctttaactgttaatgacctccttgttgaataagggttcacgttttttggtgccggatatgtctagtcaaaaaatatttgttaaatttgcaaacttcaaatttttagagttataattctaacctaatttttctccttcttctatgtggtatccgcgtaggaaggcatcggcttccatgcgttttttgcctgggatctggagggacttgatggctagtctgccttcaccggtctgaactttaaagccgtgttttgtgacttctgtgatcgttccgggctcatgagtatctatggtttctacaacatcctctacttctgcttcccagattttcatcgttttgccttcccactgggtgtaggcacttggccatggatttaagccgcggatcaggcgttcgatttctactgctgttttcgtccagtcgatctcaccggattttttattgagcatttttgcgtattcggtggtgctttcgccctgtttttgtggagtaatggttcctttttccagttctgcaagggtatggacgcagagtgcggctccttttgcggaaagtttatcgaaaaggcttcctcctgtttcttttttatctaatgtgatttctactttttccagcatatcacccgtgtcaagtccttcatccatctgcatcgttgtgacaccggatactttttctccattgatgaccgcccattggatcggtgcagcaccgcggtatttcggcagaagggatgcatggacattgatacatccatacggtgtcatttccagaatctcttttggaaggatctgtccaaacgccacgactacgcagacatctgcctgatattttttcaattcttcgatacattcaggttcccggatcttctttggctgatagaccgggatattatgtgcaagtgcacattcttttaccggagtgaactgcatttctttgcctctgccctttggcttgtccggctgtgtgacagcgagcactacttcatgtcctgcttctaccagtgcttccagtgttccgactgagaaatcaggagttcccataaatattatcttcatcttatcttaacctcccgcttccagcctaggcttcttcgtattctgtgctgtgaagttcgccttctactttttctacataaagatgaccgtccagatgctccagttcgtgacagattgctcttgccatcagtccttcgccttcgatctcgtattctttcatatcttcatcaagtgctactgcttttacataattcggacgggtaacaataccggatttacctggtacactaaggcatccttcttccccggtctgttctccgctgctctctacgatgcgtgggttgatcataacaaccggaccttctccgatatcgatgacaacgattcttttgagaattccaacctgtggtgcagcaagacctacccccattgcctcgtacatggtctctaacatatcatcgatcagttctgttgttcttggtgtcatctttgttacttccttacacacctttgtcagtacttcatcgcctatttctctgatttttctaattgccatttgttcttcctcctgccttttcttttaaaatccactcatcggatcaaaatcaaactgaatccgcatctttgcaaatccccggttcaattcaatatattgttccattttatctttcatttcaatcaggatctcataggattcctgcttcagatacaaaactttccggtacacatccttgacctttccgactgccggagctgccggaccgatcacctgtaccttgcggttcttcgtgatccgcattgcatataatttgagatagtgcattcctttttccagaagtgcttcatcctcacaggctaccagtaccgccatcagatgctctgccggcggataccccatcagttccctgtaattcatctcttctgtataaaatgcctgataatcctgacgtgctgccgtctggatactataatgctccgggctgtaggtctgaatcacgacctctcctttttttgcccctcttccggcccttcccgcagcctgcgtcagaagctcgaatgtcctctctgctgaccggaaatcatctgagtataaggacatatccgcagcaagcacgccaaccagggtcacatttggaaaatcatgtccttttacgatcatctgcgttccgacaagaatatctgcctcttcatttgcaaatgcagatagaatcttttcatgtccttctttggatcttgtagtatccagatccatccgaagtacccttgcctgcggaaattccttttttaccagttcttcaatctgctgtgttcctgcgcggaaacctccgatatgaggggagccgcaggacgggcatttttttgcaaccgtttcttcgtagccacagtagtggcacaccattttcccattattgtgcgctgccagtgaaacatcacaatgaggacattttactacatatccgcaggacctgcaagaaaggaatccggcataccctcttcgattcagaaacaaaatgatctgttctttctttttcagacggtcttccattagctcatggagcctgtcacttaaaatagaacggttccctttttgcagttcttcacgcatatccaccgtgtagacctccgggagctctgcttttgcagtccgcctctttaattccagcaacgtagactctcccagctcgcaccggtaaaatgcttccatggaaggggttgccgatcccagtaccacacttgccccttccaggcttgcgcgttcgattgccgtctcccgcgcatgataccggggaacctgttcacttttataagctgcctcatgttcctcatcaatcacgatcagcccaagactcggaaacggggtaaaaagcgcagatcttggaccgatcatcacatcaatctctccttttttcgcccgcatcatctggtcataccgctctcccgctgaaagtctggaattcatgatggaaacgcgttccccaaatgtcctgtaaaagcgcatcaccgtctggtaagtcaatgcgatctccggaatcagtacgattgcctgccgcttttcctttaccacctgccggatcatttccatatagacctctgtcttgccgcttccggtcacaccgtataaaagataggtctttcggatcccttttttataatcgttttcaaacgtccggattgcactttcctgctcctccgtgtaggtaataaaatgccgctgctgctctttttctttcacaggattacggtaaatcttatgatttttgatttccagaaccccctgctcttcaagcgctctcaccaccgtcagcgtgatattcagcttctggctgatcagagaatattctacctcttcatcatccaaaagtgctgccatcaatcttgcccgcgctttctggttcttgtgaagatattcttccagcttcttttcgcctgcttctctggaaatacatctttttaaaatccgctgttccttctgctgctcggtacgcttgatcggaagcaccgttttcaatgcctggatcatcgtacctccataatattctttcatccacgctgcaagtgcaaccagccttgcctcaatcgctacacttgatgtatctgtgcgcagaatatcctttattttttccgcatcataatcacatgtttccgaaaaaccgacaatataccccttcgtttcccggttaccccgtccaaacggcacaatgacgcctgcaccggttcgtaaatctccttccagttcttccggtacacggtactgaaatactttatccagtttttcatgtgtaatatctataataatgtctgcgtacattctgtctgttcctttttctgtctcttttgtgcagcaagcctgacggcttttcgcaccagttcccggtcatccatcggatacctgactccctggatctcctggtaattttcatgtccctttcccgcaatcaaaaggatatccccttgtcttgccatttccaccgcaaagagtactgcctcttcccgatcctggatcatccgataggctccggaagtttctttgatgccttcttcaacgtctgccataatcttcgccggctcttcccatctcggattatctgaagtgatgatcgtcagattcgcaagctctcctgccactcttcccatcccgcctcttctgcgtccggcacggttgcctccacatccaaacaccagtaaaatacgttctggttcgtaaattctcagcattttaagcacttttgcaagactcatggcattatgcgcgtaatcaatgtaacacaggatattttctcctgcatctacccgttccatcctgcctcttaccaccagatgctttaacacgtctcctgcttcttctctttcaaatccaagacagctcaccgtctgtaaagcagccagtgcattgtacacattaaattttccaggaagggcaagctcatattttctatcatctgcataaaataccgttttaagttctccaccttccatcagaaaactgattttttctgccgtcagtacatgactgtttctaaatcctctttcctgcccttcttcttcccgacaggtaaatccgtatttcgtgcaacattttctctggaacatatagctgcactgtgcatcatccagattccctattccaatcctgcactgttcaaaaagacatgatttgtaatatcggtattccccaagacttgcatgctcgcctggtccgatgtgatcctccccgaaattagtgaataccgcaatttcaaaccagattccatcgatccgatgctgctttattccctgtgaagatacctccatcaccgcatagtggcaacctgcttctaccattttagcaaaatacgactgaatggtaaaggcatccggggtcgtattttgcgaagttaccacttcatttccaagatggtggccaatcgtaccgatcagtccacatttttgaccaagactttccagcatctcccggatcatcactgccaccgtacttttcccctttgtgccggtcacgccaatcactttcaacttatcagcaggacttccaaaccagatcctgctgatcccggcaagagcttcccgtgtatcttttaccagaacgacggcaacattttccggaaacttcagcatccttcccccagataccagtttttctatcagaatgcaggatgccccaaggttgcaggcttcttctatataatcatgtccatctgcccggcttccctgaatgcagacaaacagactgtcttcttctgccttttgggaattacaggtaatcccccggatttccatctcttcttctaattccggcatttggatcaccgcatgctgaatccttttaaacagaaccgaaagcttcataaggctcctctttttggactctttgttttcagaatatgctgtttcccatcaaacgtcacaccggatatgaaaatatataaaatgggtggatttcctgctttcgttttcacgcatcctgtgcgtttgcaggaacacccacccatctctcagtctctattgatgctttttatcatactcggcaagatattctttaacatactgtgtatctgatttgcagtccagatactcacagccatatttctgccttgtctcatttccttttccggtaatcaggaaaatagtctttccctctgcttcatccatcgctgctttgattgcctctccccgatcctcgatcatggcatacggacagttttgtgcttccacatactgtgcgatttctttggaaatctgctctaccggctcatatcccggatcttccgctgtcagataaacctttttcgcatactgaccagctaccgttccaaggtctcttctccggataaatgctttctttcctgggcatccgaagatcgatacgatattataatccggatattcatctttaattgaagagaacagcttttcaaaactaagcttgttgtgtgcataatccacaacagcgatcagattcttatctgcacttccataaagctccatacgtccgctggatcttgccctcaaaagaccgctgtgcatatactccttcgggatttcaagaagaatggatgccgcaatgacagccagtgcattttccacattgaaaagtcccggcatcgtcagacggaattcttcatcaaacagctctgtttttaccataaataccgtttcatgtccgtctttctggatctcataaccataaacatccgcttccggattctttgtactgaacgtcagcaccttctcacagacctttgactctttcagaatacggtctgcaaaatctgcatccatgttcacaactccgtaacgtgattttccgaaaattttcagtttagacgaaaaatagtcttcaaaatccggatgctcgatcggactgatatggtcctctgaaatattcagaaaaattcccacatcaaactgcatgttatcgacacgattgtattttaacgcctgtgaagatacttccatctcggcaaatgtaataccactttctacggcatggcgcagatgctcctgcaattctaccgactccggcgtagtaatatgggattctttcttgatcactccgtcataaatatcgattgaagaaaggactgcactttcctttccgccggttgcttccatataatcatccacgattgctttcatatagtaagcggaagtggattttccttttgttccgccgattccggtgatcgtcagtttcttccacggtgcattattgaacttctctgcaagtggaggcatcgccttacggatatcgtctaccagaaaatatggaacatcttctttcgtttcatattttacttcgctgacataagcaatcgcacctttttcgatcgctgcatccagatactcagccttaaatgccgcacctttgcaaataaacaatgttccttccgtcacctctctggaatcataggtcagatatcctacgtttttttcttcttccccatttgaataaaattctttcatcatacgcaggttctgtaacagatttgcgtactcctgtaatgtgtatttttccatctggtatttatctcccttatattctttccggtattattcccggtactctgcgccggatctgatgatggattctcttaccagaacatccattgcatccatgcagtctgccggtacctgataatattctttgaataccgaaatctctgtgcatgcaagaattactgcatcacaaccttttgccttcagatcattataagcacggtcaaatttgttcttgtctcccggctttccttttttgatatcatcatagatcagcgacatcacatctttctggcaggcttctcccggaactaccggtgtgattccaaatttttcgcaggctcggtggtaagtctttgcctgcatcgttccatctgttcccatgatcccgatcttcttcacttttggatgagcctctactacatatctgacactctcctctaccatattgatgatcggaacacttgtagatttctggatatcttccaggaaatagtgcgaggtattgcacggaatcgcaatattttccactcccagcatctccagatctcttgcgtcctgtgtgatcgctttcagaaacggaagcttatttcctgtaaggattgcctgtgtcctgtccggcattgtcgcatgacttaaaatgatcatgttgatatgctcctgatcactctccgcctttgtcctcgcgatcactcttgcataataaaaacttgtcgcctccggtcccattccgccgataacacctaattttttcagcatatcattctccctgtttcagcttctcttagctgtaatatttcttaaagttaccaaactgtctgagatgattcttcaccatagcaagataacgtcttggtttaaaatcacctctcttaaataccggattgaccatcttcttttccttaagaaggcgtctcatcttctcacggtttgcttcttctttgatatatttgaaagcaactgccttcggtactgtcatccagagatgttcttcttttgcaaattcaagcggcagttcttttccgtaaacatattcttctactacatattttgcaacattgaatccagatcctgtcacataataattacttcgtccctggcgggtgttgatctcgaagaaacggtatttgccatcacgcctgtcatacttgatatcaaagttggagaatcctacatagtgcaaatcttccagcagattcttcaccttcatcatcagctcttcgtttggctctgtgatgataactgcatgatttccaagtccgtgtggtgtgtgttcttccaggagtacatgtcccagacacatcattttaacttttccattccggtcagaataagaagtcagaacacgcatatattcatcatttcccggaatcatatcctggatgatcagtttatctgtataacctgccccatagatatcccgaattactttttccagttcttttctgtccttgatcgtgtagatcttattctgggttgcaaacggatgctcccagtaagaaatactgtcagacggctttaaaattaccgggtacgggaaattcatctcaaaatccagtcccatggactgatcgtaaataatcgttcccggataatctaccccatgcttttcgcacaacttgtagaaagtctctttctgctgcagactgttcatcagatcaaaatcgatatatggtgcgataatatttttctcaagctctgccttatgcttactgatcagcgccacataactgtcaccacatccgatgagcataatctttttgtctttatgcttttttgcaaatccattgactgtctgaagaaaataatcgtccgtatcaatcttcggattcggatgatattcgatgatcttacttccgtaactcggtcctgttgcaaactttccaaatatatatgtcttcacctgatactgctcataaaatgcgcgggcaacactgtaagtattgatatctccaccaagcagtaccggaataaattctctgtctttaaattccattgtttaaagaagctcctttctatccccttatatttctacatatcatctcattatactccagggattctttaggtgtcaaggcatggaaacagctctgaaagtttcccgggaaattttcagaactgtttcttttcatatttcttctctttttctctctgctccagaacactgccccgtatcaccgcatccgccccatactttccgcggatctctcccattgccgcactgagctttttcagcttttccatgctcttcttcggcttctcagatttcacctcgaattgcaggtcaaacaggcttaactgctccggttcatcttcatccacaagcttcgctgtgcgaacaccaagcaatctgatcggctcaccgttccacagctcatcgaacagactgcaggccgcctcgtagatcacctgatctgcaccggatgctctgccaagctgcttctggtgagatacattctgaaaatcactgtagcggatttccacactaaccatattggctttctgccctgctttccttagtctctttcccacactttctgccagagaaaatagaaccttttttgcatcctctgccttttccacatcttttggaagtgtggtggaattaccgacaccctttgcagcggtctcctcggattgcacctttgcatcaccgattccattcgcaaattcccacagcgttctcccatgacttttcaaatggaattccagaagcttcggatctgtctgcgcaagctcaccaattgtccggatttccagcttttccagaatcgccacactggactttcctgccataaaaagctcactcaccgggagcggccacatttttcccttgacctcttccgggaaaagagtgtggacacggtttggcttttcaaagtctgatgccatttttgccagaagcttgtttgtcgaaattcccacattcacggtaaacccaaacttttcataaacccgggctttgatttcatacgcagcctccaccggcgaagaaaaacgctgtgcgattccggtaaaatccatatagcactcgtccacactgacctgctcgatttccggtgtataggttttcaggaaatccatcagtctccggctatactccctgtacatcctgtgatttggcggatccatgtgaagattcggacacttacggaacgcatttaccaccggctctcccgtccggatgccgaatttctttgccgaaggagatttcgccaatacgatcccatggcgtgattctctgtcaccgccgatgatcgcggggatcgtgcggatgtccacatcggcaccatttttcagttgttctactgccgtccaactaaggtaggctgaattgacatctatgtggaaaatgatgtgtgacattcctgctgtctcctctctgtaaataatcgagcaggctgactcctgctcgatttgtatactttgtacaccatctcgcttaacagccaggtgatgtacattcgacaaatgcagatccttgtgcaagcacaaatctgcacttggctcatcgtatacacaaaaaatacggaatatgatattcattttatcatatcccgcatccattttcattattttatcttttatttatcaagcttactgccgatttcactccatccacagttaaatacatattgtgcaaattcttccagctgcttctcattatataaacttaaatccatcgttttcagcttggattctactatttttttgttgtatctcagatcggatacatatgaacattccactctctttatcatatcatcaaatatatctctttccatatgttccctcttttctacataatgttaattatgttgtagttttcgatataggtattttgactcgaaaatatgaaaataaaaaagaaaaaataaatgttttacataattaaagtgaaaggactattttgcatttttgcaacgatttttaatgttgacagtctttgtaatacagactagaatatagttggactgagtttggacgatttatattacaacataattaacattatgtcgtcattctacaagcatttctaacatttccatgctctttttccattccataattccatccgaagcataaatccttgtcacctcgatactgctgtgtcccagaatatccgcaagctgcaacagatttccagtaaccctgtagaaaattcttgcaaacatatgtctgaaattatgcggaaatactttttcggtttccaccccggcacttactgcaagctgttttaattctctccatatattcgaccggtctttttcatgacccgatctcgttataaacacatttcccttttgaatcctgttttttcttatataatacaacagtctttttctcaactgatccgttaaaataaccggtctgtattttcctttattccacaccttcacgatccctctttgaacactatcaactgaaaaatatcttagctcactgatccggattcctgtccaagcaagcgtctccataatcattacaagctgttcctttccctgctcttttgctttccgcaccagtttgatataatcggatttctgcagttctctttccatcatctttgaattacagccctgtacacggactctgcggagcttccattttccaagcccaacggcaagtaaatactgattcagtgccacaagcatcgaatttacactgctcactgcataatgctgcaccagccactcccggtaagcaagcagaagttccttatctatttcttccgcttctgctgcataggaataaaaagtcgttacatctgtcatatatttcttctttgttgcctccgatgcttcccgctcgatcaaatacttcataaagatttctttttcaaatttcattccgctcataatgtgtcctcctagttttctctttttactcacattatttcacagatctgaaattttattaaccgaaaaagcagtaggacaaaaacttttttcattgtcctgctgctcatatccgcctatttttcttaattgattttaatttgcatgaatcctatcatagtagtactggaaatctggaagtggaatatccttctttttaatatttttctgaggataaaaaagtaattccacctcttttggtggcatcatctggagttcttcaatcggaattcctcccgcgtgataacgttccataatcaaagataatgttccggatccaatcttataccgatccatgctggagcttcttaatttttatattatattggcttgaatccttttccacgcacttcattcgattccattgtaacaagaaacgctgatgaatctactttctttacagcttcttgaatcgtatacatttctttattgttacatgcacacattaatacttctttttcacgtcctgtataacttccttctgccttaatcaaagttgcccctcgttgtgatagctcatcaatttttgccgcaatttgtggccccttttctgttacaatcaaagcaagttttccagcatcaacgccatacattagcttatctacgacaaatgatagaatatacgttccaattaatccataaataatcttatcaatgtttccatgcatcagaattccaccaataattacaataataaaatccataacaatgataatttttcctacagaaatatgtggctttgccttgtgtattgccatcaaaacaaaatctgctccacctgtagaggtatctctcatgtaaattaatgcatatccgattcctgagaatacactcatacaaatacaagataacatcatatcaccttggtaaattggaagcaatggaacaacccagtccatcagtatattagaaattaacattgtctttattgatcttaaaaaaaattgttttcccaacaacttgtaacaaattaaaataattggaatattcaaaattgtcgtcattgtaccaattggaattttccaaaaataataaaacacgattgcaatacctgatatacctgctaccggaaatccagatgccactgcaaaattatagactccaatcgcaatgaaacaaccacctacaatatcaagtaaaatatcaattaaaaatgtctttgcctttgatttcaatgtgagttcctccctattacggaatcttatttcttttgcatcacaatacattgatatgtttgcagttttattgaacctgtaaggatttcatcagtaatcaaatttgtataacattcattcaaaaccatcttcacaggatatctgttaaaattctgaagaaaatatacatcatctttctgttcttttccacttctttttgaaacagtaactccataaggtaatgtttccgtcaaatttgcttccacatttgcttcctcaattacatcgcccaaaaattctttcaagaattccagatctggttgaacagcaacatagtaagcttttcctttgccatacgcattttctgtaattgctggagtatttacattgtaatcttgcaagtatgttcccaacggctttgcagtttgaagtgtcacaacttctcttaacacaccggctttatatacaccgtctttataggagaaagtatttggaaaatattcattccccacatcaatctcatcaactgataatcctagcaatctctcatgtggtctctctccaataaaacataaatctgtttcatttactactccactccaataagttgttacatatattccacctgcttccacgtatgcttctactttatgaatatactcttttttatgcaagtacaaggtcggagcaaccacaagctgataatctgacaactctcgatccatggaaattatatcaacttcaattcctttttcccaaaaaacccgataatattttaaaagttcttccgtataatcaaattttctcgatattgcttgtgcgtcagaaagagcccaccaattttcccaatccataataatagctaccttcgccctattacatgtacttagtatttgactgcttagcttttctagatctttgccaatccaagcaacttcttgaaaaactctattcttttctgacgcatcatgaccaacaaccgctccatgaaacttttcactcgatcctctgctttttctccattgaaaataaagaacactattcgaacctaacgcaattgcctgcattgaagataagtaattcatccccggtctttttacattattttcctcatcccaattcacaagtgatggtgttgattccatcatcaaaaatggcttcttctgaaatcctctcatctggttatgcataaaggctgcccacacagcaatcggtacttcatcttcttttgtatgccaactcggataagagtcccaagaaatcacatccaactcctttgcccatttatcataatccaatggtgaaaaatacatcatcatgtttgttgtaactggaagatccgaatatgttttaacagctcgaatctcttctctacaaaagtcctgtaactgttcgctcacaaatcttttccagtccaatttcaaaccgtgtaattcatcctctcccctcggagaaggtgaatgaatctgttcccaatcggtataagtatgactccaaaacgcactccaccatgcatgattcaatgcatccaatgttttgtatttttttttcaaccatttccgaaatgctttttgacattcttcgcaatgacaagaagcatccctaaaatttcctccgtattcgtttgatatatgccaaagaattactcctggatgttttccaaagcgttctgataatttcaaatccaactttctagttttttctctcataacagcagacgtgtaacaaaaattatgcctttttcctggtaaattctgtatcccgttttcatctgtctgcattacttcaggatatttttgagtcatccaatttggcattgcacctgttggtgtagctagatttgtatagatgccattgtcatataaacggttaataatttcttctaaatagtcaaactgatattttccttcttctggctctaaaaatgcccacgaaaatattcctagtgaaacattatttacatgcgctaatttcattaaccggatatcctcttcaagaatatccggtctatctaaccattgttcaggattataatctccaccatgcagaagacctggcatatttatttttttatattccatttctaatccctttctttatagatatcatttattattttacagctccagtaataccttctgcaaaactcttctgtaaaataaagaatactaaggcggtaggcaatgtacatattaagactgccaacataagcattccatagtctgttacatatccctctgtcagatttgctacaaccattggcattgtcatgctctcggattgtgtcatgattactttcggccacatataactattccaagcattcataaatgtaatagtcatagccgctgcatatgttgatttcattgtaggaataaacatctgaaagaagattctaatttccgaaagtccatctaatctggcagcttcaataatatcacgaggaaatgatcttgcactctgccgaaacatcatgattaaaaatggggttgatatcgttggtaaaatgaatcccaacgtactatttaacattttcatttttgcaaccatctgaaacaatgggaccaatatcgtaataaatggaaccatcatcgcaagaagaatcacacccatcacggcatcttttgctttatcatgataaatttcaaatccatatcctgccaaggaacatatcaccatcgaaactattgtaagtaatattgcatatttaaatgaattgaccaatgcagcccatacatcttgatttgccagcagatttttcaagttttctcccaaatgagagccaaacgataatacaccttttgatacatccacacttttgtttgtggatgcacttaccatccagtacaaaggaaatactgaaataaaagtaaccaaaatcaagaatgcatacattcctatatttttcatttttttaatcacgtttatcacccaccctcatttgtataaatgctaatactgcaaccaacagtaatataaagaaggacatcgctgctgcatatccaaaattcggcacatacttaaaacataaattatatatgtaatgtgacatagagatcgaagcattcgcaggacctccatcggtcaagttaattgattcatcaaataactgtaatgttccatttgttgacattattgctgtcaacaagatagttggttttaataatggaacagtaatcttaaaaaatgtctgtattgctgatgctccatcaatttttgcagcttcgtatactgaatattcaatgttttgcaatccagaaaggaaaaataccatattatatcctgtccatctccacaaaagagccaatatgataactatttttgccgcaaatggttgtgtcaaaaaattatatggtttatccaaaattcccaaattcactagaacataatttactaatccatcatttgcaaacaaagaccgaaaaataattgagtacgcaaccaatgaagttgtacacggcaaaaaaatcattgttcggaaaaatcctttaaaccgtaagtcttttttatttagaatacaagctaacaccatcgctactacaagcataatgggcacttgaagaatgaaataaaaaaatgtgttttttattgactgaataaatacatcatcttgaaacattctgatgtaatttgtaaatccagccatctgcatatttctacctttccccgtctgaaaagataaaactaacgctttaatcattggccaaaaactaaacaccgcaatcaaaaatgttgctggtgccaaaaaagcccatcctgttaaattatgctttttttccaacgtcatttttcttggtttgttagacacaaaaactcctcctctctatccataagggagatggttctacattccatccccttgtatgataggaacctttcttactgtcccatattaaaattaacagtatcttccgcttttttaagctctttctttaaatctgcaccatttgtaatatttgttgtcgcaacagagattgcgtctcttgcttcatggaaatatggtcccgtaataatagaaggaacttttgttgaatagtcaactattttttcaaacactgcatcaccagagaaaaattcattcggtactgcatatgcatcagaatctcctgctggtgtccatgtagcaattgctccacaagagagaatattattatataactctgtacttccagcaaatgtagatgcaagaaaatcttctgctaactctacgtttccacaattccctgagattgcccaggaagaacctccaatatttgaatagtttgtggcaccctttacatttgtaagttttggaatatttgtaatagcccattttcctgactgatcctcagctgtctgaattgttcccataatccaacacccattaatcacacctgcaacttcactgttcaacattgagccagtgtattcatcccagttatttacttcctgtaacacacctgaatctttcattttacaatatgtatcaattaccttcttcaaagtgtcattttttgcaatattcgttgttccatcttcattaaacaaagatgctcctgcagactgtaacatcatcgtaagcaaatcacattcgcctgctgtcgttgtcaataatggttttcctgttttttccagtactactttgcctttttcaacccactcatcccaggtaatatctgtaaaatcttctaaagtcattccagcttcttgcaaaatatctgtacgataacaagcaattgctgctccgttgtcaaaaggcactccatagtgttttccatctacaacagaaaaatctgttttaccaggagcaaattctgaaaaatcaattttcttttcagaaatttctgtaaatacatctggataagataatacatttttttggaatgcctggtcttgcatcaaaaaaatatctggcaatgtgcttagatctcctgatgtaccagccgtagtaagtctagactgtacatctacatctccaacttcgacaatatcaattttcacatcttgatgatcttcttgataaatttttgcagcttcttccattgcaaaaatattaaatgttttgtcccaacaccatactgtaattgtattatcgtcttttttgtcccctgaacctccgcatgctgcaatacccattgccatcgtagctatcaataaaattgccactattttttttctcattcgttatattctccttctaccatgccccttgataccctattgttaccgcactattctgagctcctgcttccatcgaatcttgaacattcaatccattcaaaatcccatataaaaatccggcaataaaactgtcgcctgcacccattgtatcaacaactttacactctatgattccaaatcgataccaagaatttccatcatacccaatgcttccatttttccccaatgttgcaataatgactttaggtcctttttgttgcattgctttcatgaattcctttaattgttccgtacaattttctttttcttttaagcccatgctatgatatttctgtctaaactcattgcgtgattcctcgtcaaaagagaagaatgcatatgtcacatatggaatcgctttctcaacaattggatttgcaaatttattggcaaaatcaaatgcaactggaatttctttcgaaataagtggaagctcatcttcaatcattccccaaattcctgtaaccgctaaatcatgtttctttataaaggaaatgtcttgttctcttagcttaaagtctgccaaaacaccttcttcatattttccaaacactctatctccatctacaatgtcaacatgtgtaactgcggtttttccatccagcacttgaacatgagaagtatcgactcctttattttgaattgcacttatcatgatttttccgaatgaatcagttccaacagcacctgtataagaactttctccacctaatcgttttatgtatacagcaacattcactgggtttccccctggataagattcattcaatgaatcataataatcaatacaattatctcctattgctgctactcttatctttctgtccattttgccaccttaatagtccagacatctgtaatatcttctgatttccataggatgacaattgactttttccatatgtgcatcaattctctgtgttaccgcatgcatcactaaatgtgatatatatcctctgtactctggactaattccttttaattcaaatttcttggtatcaataatattgtattttccacaaatgcgtggcaagaagtttgcaacgcgctcgctcaatgatctctgagaatcttccccaataaatactgtaactggtgtatctttgtcaattatttctaacattccatggaaaaattctgcactgtggatagattttgtacgaatccaatgctgttcttcccaataacacattgcataagaatatgtggcaccatactggttcccagccccaacaaaataatgaattttgtcatccttatgacgatttgcaaattcttctccgaaagcatctgcttccttttcaacttccacaagtgcagttgccaaatactgatccaactccttgtataaatcctcatattctggaaattctcctgcattgtacataaatctatctgctaccatataaaatttcaattgttcattggcaggatatgtaatcacatagtctacaagttttgcaagttctgcagtagcaacatcaataaaaccaatcacccttgctc
